United States Patent 12,473,334 (SWI/SNF FAMILY CHROMATIN REMODELING COMPLEXES AND USES THEREOF) - sequence listing, part 2

SEQ ID NO: 14018 - protein, 7 aa, Homo sapiens
IRNHKYR

SEQ ID NO: 14019 - protein, 5 aa, Homo sapiens
NHKYR

SEQ ID NO: 14020 - protein, 13 aa, Homo sapiens
LTCEEEEEKMFGR

SEQ ID NO: 14021 - protein, 13 aa, Homo sapiens
LTCEEEEEKMFGR

SEQ ID NO: 14022 - protein, 13 aa, Homo sapiens
LTCEEEEEKMFGR

SEQ ID NO: 14023 - protein, 13 aa, Homo sapiens
LTCEEEEEKMFGR

SEQ ID NO: 14024 - protein, 13 aa, Homo sapiens
LTCEEEEEKMFGR

SEQ ID NO: 14025 - protein, 5 aa, Homo sapiens
LKGGR

SEQ ID NO: 14026 - protein, 17 aa, Homo sapiens
KKIPDPDSDDVSEVDAR

SEQ ID NO: 14027 - protein, 4 aa, Homo sapiens
KDKR

SEQ ID NO: 14028 - protein, 5 aa, Homo sapiens
LKGGR

SEQ ID NO: 14029 - protein, 5 aa, Homo sapiens
LKGGR

SEQ ID NO: 14030 - protein, 5 aa, Homo sapiens
IKLGR

SEQ ID NO: 14031 - protein, 11 aa, Homo sapiens
KELPEYYELIR

SEQ ID NO: 14032 - protein, 10 aa, Homo sapiens
VSYKGSPAAR

SEQ ID NO: 14033 - protein, 10 aa, Homo sapiens
VSYKGSPAAR

SEQ ID NO: 14034 - protein, 10 aa, Homo sapiens
VSYKGSPAAR

SEQ ID NO: 14035 - protein, 7 aa, Homo sapiens
KEKAQDR

SEQ ID NO: 14036 - protein, 6 aa, Homo sapiens
LKGGRR

SEQ ID NO: 14037 - protein, 7 aa, Homo sapiens
ITEKLEK

SEQ ID NO: 14038 - protein, 7 aa, Homo sapiens
ITEKLEK

SEQ ID NO: 14039 - protein, 7 aa, Homo sapiens
ITEKLEK

SEQ ID NO: 14040 - protein, 8 aa, Homo sapiens
QQKIEQER

SEQ ID NO: 14041 - protein, 9 aa, Homo sapiens
QHKAAQVAK

SEQ ID NO: 14042 - protein, 17 aa, Homo sapiens
KKIPDPDSDDVSEVDAR

SEQ ID NO: 14043 - protein, 17 aa, Homo sapiens
KKIPDPDSDDVSEVDAR

SEQ ID NO: 14044 - protein, 22 aa, Homo sapiens
HIIENAKQDVDDEYGVSQALAR

SEQ ID NO: 14045 - protein, 22 aa, Homo sapiens
HIIENAKQDVDDEYGVSQALAR

SEQ ID NO: 14046 - protein, 22 aa, Homo sapiens
HIIENAKQDVDDEYGVSQALAR

SEQ ID NO: 14047 - protein, 7 aa, Homo sapiens
IRNHKYR

SEQ ID NO: 14048 - protein, 7 aa, Homo sapiens
IRNHKYR

SEQ ID NO: 14049 - protein, 7 aa, Homo sapiens
DKDDESK

SEQ ID NO: 14050 - protein, 6 aa, Homo sapiens
LIDQKK

SEQ ID NO: 14051 - protein, 7 aa, Homo sapiens
KLIDQKK

SEQ ID NO: 14052 - protein, 6 aa, Homo sapiens
LIDQKK

SEQ ID NO: 14053 - protein, 7 aa, Homo sapiens
KLIDQKK

SEQ ID NO: 14054 - protein, 7 aa, Homo sapiens
KLIDQKK

SEQ ID NO: 14055 - protein, 6 aa, Homo sapiens
LIDQKK

SEQ ID NO: 14056 - protein, 7 aa, Homo sapiens
KLIDQKK

SEQ ID NO: 14057 - protein, 6 aa, Homo sapiens
LIDQKK

SEQ ID NO: 14058 - protein, 4 aa, Homo sapiens
RKPR

SEQ ID NO: 14059 - protein, 4 aa, Homo sapiens
RKPR

SEQ ID NO: 14060 - protein, 4 aa, Homo sapiens
RKPR

SEQ ID NO: 14061 - protein, 4 aa, Homo sapiens
RKPR

SEQ ID NO: 14062 - protein, 4 aa, Homo sapiens
RKPR

SEQ ID NO: 14063 - protein, 4 aa, Homo sapiens
RKPR

SEQ ID NO: 14064 - protein, 4 aa, Homo sapiens
RKPR

SEQ ID NO: 14065 - protein, 10 aa, Homo sapiens
LDGTTKAEDR

SEQ ID NO: 14066 - protein, 10 aa, Homo sapiens
LDGTTKAEDR

SEQ ID NO: 14067 - protein, 13 aa, Homo sapiens
LTCEEEEEKMFGR

SEQ ID NO: 14068 - protein, 10 aa, Homo sapiens
LDGTTKAEDR

SEQ ID NO: 14069 - protein, 10 aa, Homo sapiens
LDGTTKAEDR

SEQ ID NO: 14070 - protein, 10 aa, Homo sapiens
LDGTTKAEDR

SEQ ID NO: 14071 - protein, 10 aa, Homo sapiens
LDGTTKAEDR

SEQ ID NO: 14072 - protein, 10 aa, Homo sapiens
LDGTTKAEDR

SEQ ID NO: 14073 - protein, 13 aa, Homo sapiens
YLRLDGTTKAEDR

SEQ ID NO: 14074 - protein, 6 aa, Homo sapiens
LKGGRR

SEQ ID NO: 14075 - protein, 5 aa, Homo sapiens
LKGGR

SEQ ID NO: 14076 - protein, 5 aa, Homo sapiens
LKGGR

SEQ ID NO: 14077 - protein, 5 aa, Homo sapiens
LKGGR

SEQ ID NO: 14078 - protein, 10 aa, Homo sapiens
LDGTTKAEDR

SEQ ID NO: 14079 - protein, 14 aa, Homo sapiens
HRKEVDYSDSLTEK

SEQ ID NO: 14080 - protein, 10 aa, Homo sapiens
LDGTTKAEDR

SEQ ID NO: 14081 - protein, 10 aa, Homo sapiens
LDGTTKAEDR

SEQ ID NO: 14082 - protein, 10 aa, Homo sapiens
LDGTTKAEDR

SEQ ID NO: 14083 - protein, 5 aa, Homo sapiens
IKLGR

SEQ ID NO: 14084 - protein, 10 aa, Homo sapiens
LDGTTKAEDR

SEQ ID NO: 14085 - protein, 4 aa, Homo sapiens
KSSR

SEQ ID NO: 14086 - protein, 10 aa, Homo sapiens
LDGTTKAEDR

SEQ ID NO: 14087 - protein, 10 aa, Homo sapiens
VSYKGSPAAR

SEQ ID NO: 14088 - protein, 10 aa, Homo sapiens
VSYKGSPAAR

SEQ ID NO: 14089 - protein, 10 aa, Homo sapiens
VSYKGSPAAR

SEQ ID NO: 14090 - protein, 10 aa, Homo sapiens
VSYKGSPAAR

SEQ ID NO: 14091 - protein, 10 aa, Homo sapiens
VSYKGSPAAR

SEQ ID NO: 14092 - protein, 22 aa, Homo sapiens
GMLLKTFNEPGSEYFIFLLSTR

SEQ ID NO: 14093 - protein, 22 aa, Homo sapiens
GMLLKTFNEPGSEYFIFLLSTR

SEQ ID NO: 14094 - protein, 22 aa, Homo sapiens
GMLLKTFNEPGSEYFIFLLSTR

SEQ ID NO: 14095 - protein, 22 aa, Homo sapiens
GMLLKTFNEPGSEYFIFLLSTR

SEQ ID NO: 14096 - protein, 22 aa, Homo sapiens
GMLLKTFNEPGSEYFIFLLSTR

SEQ ID NO: 14097 - protein, 7 aa, Homo sapiens
IRNHKYR

SEQ ID NO: 14098 - protein, 4 aa, Homo sapiens
KMKK

SEQ ID NO: 14099 - protein, 7 aa, Homo sapiens
KEKAQDR

SEQ ID NO: 14100 - protein, 7 aa, Homo sapiens
KEKAQDR

SEQ ID NO: 14101 - protein, 7 aa, Homo sapiens
KEKAQDR

SEQ ID NO: 14102 - protein, 7 aa, Homo sapiens
KEKAQDR

SEQ ID NO: 14103 - protein, 5 aa, Homo sapiens
IKLGR

SEQ ID NO: 14104 - protein, 5 aa, Homo sapiens
IKLGR

SEQ ID NO: 14105 - protein, 5 aa, Homo sapiens
NHKYR

SEQ ID NO: 14106 - protein, 7 aa, Homo sapiens
IRNHKYR

SEQ ID NO: 14107 - protein, 7 aa, Homo sapiens
IRNHKYR

SEQ ID NO: 14108 - protein, 5 aa, Homo sapiens
NHKYR

SEQ ID NO: 14109 - protein, 5 aa, Homo sapiens
NHKYR

SEQ ID NO: 14110 - protein, 5 aa, Homo sapiens
NHKYR

SEQ ID NO: 14111 - protein, 5 aa, Homo sapiens
NHKYR

SEQ ID NO: 14112 - protein, 5 aa, Homo sapiens
NHKYR

SEQ ID NO: 14113 - protein, 7 aa, Homo sapiens
IRNHKYR

SEQ ID NO: 14114 - protein, 5 aa, Homo sapiens
NHKYR

SEQ ID NO: 14115 - protein, 7 aa, Homo sapiens
IRNHKYR

SEQ ID NO: 14116 - protein, 5 aa, Homo sapiens
NHKYR

SEQ ID NO: 14117 - protein, 5 aa, Homo sapiens
NHKYR

SEQ ID NO: 14118 - protein, 5 aa, Homo sapiens
NHKYR

SEQ ID NO: 14119 - protein, 5 aa, Homo sapiens
NHKYR

SEQ ID NO: 14120 - protein, 5 aa, Homo sapiens
NHKYR

SEQ ID NO: 14121 - protein, 5 aa, Homo sapiens
NHKYR

SEQ ID NO: 14122 - protein, 5 aa, Homo sapiens
LKGGR

SEQ ID NO: 14123 - protein, 17 aa, Homo sapiens
GRPPAEKLSPNPPNLTK

SEQ ID NO: 14124 - protein, 6 aa, Homo sapiens
KPVDFK

SEQ ID NO: 14125 - protein, 6 aa, Homo sapiens
KPVDFK

SEQ ID NO: 14126 - protein, 6 aa, Homo sapiens
KPVDFK

SEQ ID NO: 14127 - protein, 4 aa, Homo sapiens
KMKK

SEQ ID NO: 14128 - protein, 5 aa, Homo sapiens
IKLGR

SEQ ID NO: 14129 - protein, 5 aa, Homo sapiens
IKLGR

SEQ ID NO: 14130 - protein, 5 aa, Homo sapiens
IKLGR

SEQ ID NO: 14131 - protein, 14 aa, Homo sapiens
HRKEVDYSDSLTEK

SEQ ID NO: 14132 - protein, 14 aa, Homo sapiens
HRKEVDYSDSLTEK

SEQ ID NO: 14133 - protein, 5 aa, Homo sapiens
LKGGR

SEQ ID NO: 14134 - protein, 5 aa, Homo sapiens
LKGGR

SEQ ID NO: 14135 - protein, 16 aa, Homo sapiens
KRDSDAGSSTPTTSTR

SEQ ID NO: 14136 - protein, 16 aa, Homo sapiens
KRDSDAGSSTPTTSTR

SEQ ID NO: 14137 - protein, 16 aa, Homo sapiens
KRDSDAGSSTPTTSTR

SEQ ID NO: 14138 - protein, 12 aa, Homo sapiens
KEVDYSDSLTEK

SEQ ID NO: 14139 - protein, 5 aa, Homo sapiens
NHKYR

SEQ ID NO: 14140 - protein, 7 aa, Homo sapiens
IRNHKYR

SEQ ID NO: 14141 - protein, 14 aa, Homo sapiens
HRKEVDYSDSLTEK

SEQ ID NO: 14142 - protein, 10 aa, Homo sapiens
VSYKGSPAAR

SEQ ID NO: 14143 - protein, 14 aa, Homo sapiens
HRKEVDYSDSLTEK

SEQ ID NO: 14144 - protein, 14 aa, Homo sapiens
HRKEVDYSDSLTEK

SEQ ID NO: 14145 - protein, 5 aa, Homo sapiens
LKGGR

SEQ ID NO: 14146 - protein, 5 aa, Homo sapiens
LKGGR

SEQ ID NO: 14147 - protein, 5 aa, Homo sapiens
LKGGR

SEQ ID NO: 14148 - protein, 5 aa, Homo sapiens
LKGGR

SEQ ID NO: 14149 - protein, 11 aa, Homo sapiens
WKYMIVDEGHR

SEQ ID NO: 14150 - protein, 11 aa, Homo sapiens
WKYMIVDEGHR

SEQ ID NO: 14151 - protein, 7 aa, Homo sapiens
VKIKLGR

SEQ ID NO: 14152 - protein, 7 aa, Homo sapiens
KEKAQDR

SEQ ID NO: 14153 - protein, 7 aa, Homo sapiens
KEKAQDR

SEQ ID NO: 14154 - protein, 5 aa, Homo sapiens
IKLGR

SEQ ID NO: 14155 - protein, 7 aa, Homo sapiens
KEKAQDR

SEQ ID NO: 14156 - protein, 7 aa, Homo sapiens
KEKAQDR

SEQ ID NO: 14157 - protein, 7 aa, Homo sapiens
KEKAQDR

SEQ ID NO: 14158 - protein, 7 aa, Homo sapiens
KEKAQDR

SEQ ID NO: 14159 - protein, 7 aa, Homo sapiens
KEKAQDR

SEQ ID NO: 14160 - protein, 5 aa, Homo sapiens
IKLGR

SEQ ID NO: 14161 - protein, 4 aa, Homo sapiens
IKER

SEQ ID NO: 14162 - protein, 4 aa, Homo sapiens
IKER

SEQ ID NO: 14163 - protein, 5 aa, Homo sapiens
KIKER

SEQ ID NO: 14164 - protein, 5 aa, Homo sapiens
LKGGR

SEQ ID NO: 14165 - protein, 11 aa, Homo sapiens
LHKVLRPFLLR

SEQ ID NO: 14166 - protein, 11 aa, Homo sapiens
LHKVLRPFLLR

SEQ ID NO: 14167 - protein, 11 aa, Homo sapiens
LHKVLRPFLLR

SEQ ID NO: 14168 - protein, 11 aa, Homo sapiens
WKYMIVDEGHR

SEQ ID NO: 14169 - protein, 11 aa, Homo sapiens
WKYMIVDEGHR

SEQ ID NO: 14170 - protein, 11 aa, Homo sapiens
WKYMIVDEGHR

SEQ ID NO: 14171 - protein, 22 aa, Homo sapiens
HIIENAKQDVDDEYGVSQALAR

SEQ ID NO: 14172 - protein, 11 aa, Homo sapiens
WKYMIVDEGHR

SEQ ID NO: 14173 - protein, 22 aa, Homo sapiens
HIIENAKQDVDDEYGVSQALAR

SEQ ID NO: 14174 - protein, 11 aa, Homo sapiens
WKYMIVDEGHR

SEQ ID NO: 14175 - protein, 16 aa, Homo sapiens
TIQTIALITYLMEHKR

SEQ ID NO: 14176 - protein, 8 aa, Homo sapiens
EQKKENER

SEQ ID NO: 14177 - protein, 8 aa, Homo sapiens
EQKKENER

SEQ ID NO: 14178 - protein, 5 aa, Homo sapiens
KENER

SEQ ID NO: 14179 - protein, 6 aa, Homo sapiens
LIDQKK

SEQ ID NO: 14180 - protein, 8 aa, Homo sapiens
YKLNVDQK

SEQ ID NO: 14181 - protein, 14 aa, Homo sapiens
ILAAAKYKLNVDQK

SEQ ID NO: 14182 - protein, 8 aa, Homo sapiens
YKLNVDQK

SEQ ID NO: 14183 - protein, 8 aa, Homo sapiens
EEARNPKR

SEQ ID NO: 14184 - protein, 8 aa, Homo sapiens
EEARNPKR

SEQ ID NO: 14185 - protein, 8 aa, Homo sapiens
EEARNPKR

SEQ ID NO: 14186 - protein, 6 aa, Homo sapiens
KPVDFK

SEQ ID NO: 14187 - protein, 6 aa, Homo sapiens
IQKLTK

SEQ ID NO: 14188 - protein, 16 aa, Homo sapiens
KRDSDAGSSTPTTSTR

SEQ ID NO: 14189 - protein, 16 aa, Homo sapiens
KRDSDAGSSTPTTSTR

SEQ ID NO: 14190 - protein, 16 aa, Homo sapiens
KRDSDAGSSTPTTSTR

SEQ ID NO: 14191 - protein, 6 aa, Homo sapiens
QKKSSR

SEQ ID NO: 14192 - protein, 7 aa, Homo sapiens
AKDDIKK

SEQ ID NO: 14193 - protein, 4 aa, Homo sapiens
WEKR

SEQ ID NO: 14194 - protein, 9 aa, Homo sapiens
VMATIEKVR

SEQ ID NO: 14195 - protein, 7 aa, Homo sapiens
AKDDIKK

SEQ ID NO: 14196 - protein, 9 aa, Homo sapiens
VMATIEKVR

SEQ ID NO: 14197 - protein, 9 aa, Homo sapiens
VMATIEKVR

SEQ ID NO: 14198 - protein, 7 aa, Homo sapiens
AKDDIKK

SEQ ID NO: 14199 - protein, 7 aa, Homo sapiens
AKDDIKK

SEQ ID NO: 14200 - protein, 7 aa, Homo sapiens
AKDDIKK

SEQ ID NO: 14201 - protein, 9 aa, Homo sapiens
VMATIEKVR

SEQ ID NO: 14202 - protein, 4 aa, Homo sapiens
KWEK

SEQ ID NO: 14203 - protein, 4 aa, Homo sapiens
KWEK

SEQ ID NO: 14204 - protein, 5 aa, Homo sapiens
KWEKK

SEQ ID NO: 14205 - protein, 7 aa, Homo sapiens
AKDDIKR

SEQ ID NO: 14206 - protein, 11 aa, Homo sapiens
IYKWVPVTEPK

SEQ ID NO: 14207 - protein, 7 aa, Homo sapiens
AKDDIKR

SEQ ID NO: 14208 - protein, 7 aa, Homo sapiens
AKDDIKR

SEQ ID NO: 14209 - protein, 7 aa, Homo sapiens
AKDDIKR

SEQ ID NO: 14210 - protein, 9 aa, Homo sapiens
VMAAIEKVR

SEQ ID NO: 14211 - protein, 9 aa, Homo sapiens
VMAAIEKVR

SEQ ID NO: 14212 - protein, 9 aa, Homo sapiens
VMAAIEKVR

SEQ ID NO: 14213 - protein, 7 aa, Homo sapiens
AKDDIKR

SEQ ID NO: 14214 - protein, 7 aa, Homo sapiens
AKDDIKR

SEQ ID NO: 14215 - protein, 9 aa, Homo sapiens
VMAAIEKVR

SEQ ID NO: 14216 - protein, 9 aa, Homo sapiens
VMAAIEKVR

SEQ ID NO: 14217 - protein, 7 aa, Homo sapiens
AKDDIKR

SEQ ID NO: 14218 - protein, 7 aa, Homo sapiens
AKDDIKR

SEQ ID NO: 14219 - protein, 7 aa, Homo sapiens
AKDDIKR

SEQ ID NO: 14220 - protein, 7 aa, Homo sapiens
AKDDIKR

SEQ ID NO: 14221 - protein, 7 aa, Homo sapiens
AKDDIKR

SEQ ID NO: 14222 - protein, 9 aa, Homo sapiens
VMAAIEKVR

SEQ ID NO: 14223 - protein, 7 aa, Homo sapiens
AKDDIKR

SEQ ID NO: 14224 - protein, 7 aa, Homo sapiens
AKDDIKR

SEQ ID NO: 14225 - protein, 5 aa, Homo sapiens
KWEKK

SEQ ID NO: 14226 - protein, 11 aa, Homo sapiens
KWVTVGDTSLR

SEQ ID NO: 14227 - protein, 11 aa, Homo sapiens
KWVTVGDTSLR

SEQ ID NO: 14228 - protein, 11 aa, Homo sapiens
KWVTVGDTSLR

SEQ ID NO: 14229 - protein, 11 aa, Homo sapiens
KWVTVGDTSLR

SEQ ID NO: 14230 - protein, 11 aa, Homo sapiens
KWVTVGDTSLR

SEQ ID NO: 14231 - protein, 8 aa, Homo sapiens
VDDKNKNK

SEQ ID NO: 14232 - protein, 6 aa, Homo sapiens
VDDKNK

SEQ ID NO: 14233 - protein, 11 aa, Homo sapiens
KWVTVGDTSLR

SEQ ID NO: 14234 - protein, 11 aa, Homo sapiens
KWVTVGDTSLR

SEQ ID NO: 14235 - protein, 7 aa, Homo sapiens
AKDDIKR

SEQ ID NO: 14236 - protein, 8 aa, Homo sapiens
VDDKNKNK

SEQ ID NO: 14237 - protein, 10 aa, Homo sapiens
VMAAIEKVRK

SEQ ID NO: 14238 - protein, 8 aa, Homo sapiens
VDDKNKNK

SEQ ID NO: 14239 - protein, 6 aa, Homo sapiens
VDDKNK

SEQ ID NO: 14240 - protein, 9 aa, Homo sapiens
VMAAIEKVR

SEQ ID NO: 14241 - protein, 9 aa, Homo sapiens
VMAAIEKVR

SEQ ID NO: 14242 - protein, 11 aa, Homo sapiens
KWVTVGDTSLR

SEQ ID NO: 14243 - protein, 5 aa, Homo sapiens
KWEKK

SEQ ID NO: 14244 - protein, 4 aa, Homo sapiens
WEKK

SEQ ID NO: 14245 - protein, 9 aa, Homo sapiens
VMAAIEKVR

SEQ ID NO: 14246 - protein, 11 aa, Homo sapiens
IYKWVPVTEPK

SEQ ID NO: 14247 - protein, 11 aa, Homo sapiens
IYKWVPVTEPK

SEQ ID NO: 14248 - protein, 9 aa, Homo sapiens
VMAAIEKVR

SEQ ID NO: 14249 - protein, 6 aa, Homo sapiens
KGKDEK

SEQ ID NO: 14250 - protein, 9 aa, Homo sapiens
VMAAIEKVR

SEQ ID NO: 14251 - protein, 5 aa, Homo sapiens
KWEKK

SEQ ID NO: 14252 - protein, 9 aa, Homo sapiens
VMAAIEKVR

SEQ ID NO: 14253 - protein, 4 aa, Homo sapiens
KWEK

SEQ ID NO: 14254 - protein, 4 aa, Homo sapiens
KWEK

SEQ ID NO: 14255 - protein, 4 aa, Homo sapiens
KWEK

SEQ ID NO: 14256 - protein, 9 aa, Homo sapiens
VMAAIEKVR

SEQ ID NO: 14257 - protein, 5 aa, Homo sapiens
KWEKK

SEQ ID NO: 14258 - protein, 22 aa, Homo sapiens
KDLYANTVLSGGSTMYPGIADR

SEQ ID NO: 14259 - protein, 13 aa, Homo sapiens
SHRNIKLLEDEPR

SEQ ID NO: 14260 - protein, 9 aa, Homo sapiens
KNNLFVVDR

SEQ ID NO: 14261 - protein, 9 aa, Homo sapiens
KNNLFVVDR

SEQ ID NO: 14262 - protein, 10 aa, Homo sapiens
FDKLPIKIVK

SEQ ID NO: 14263 - protein, 9 aa, Homo sapiens
KNNLFVVDR

SEQ ID NO: 14264 - protein, 9 aa, Homo sapiens
KNNLFVVDR

SEQ ID NO: 14265 - protein, 9 aa, Homo sapiens
KNNLFVVDR

SEQ ID NO: 14266 - protein, 9 aa, Homo sapiens
KNNLFVVDR

SEQ ID NO: 14267 - protein, 9 aa, Homo sapiens
KNNLFVVDR

SEQ ID NO: 14268 - protein, 6 aa, Homo sapiens
KLWVDR

SEQ ID NO: 14269 - protein, 13 aa, Homo sapiens
ITKVYELGNEPER

SEQ ID NO: 14270 - protein, 6 aa, Homo sapiens
KLWVDR

SEQ ID NO: 14271 - protein, 6 aa, Homo sapiens
KLWVDR

SEQ ID NO: 14272 - protein, 19 aa, Homo sapiens
GSPVSSLPAVGKKPLDLFR

SEQ ID NO: 14273 - protein, 7 aa, Homo sapiens
KPLDLFR

SEQ ID NO: 14274 - protein, 7 aa, Homo sapiens
KPLDLFR

SEQ ID NO: 14275 - protein, 19 aa, Homo sapiens
GSPVSSLPAVGKKPLDLFR

SEQ ID NO: 14276 - protein, 21 aa, Homo sapiens
SSTISVHDPFSDVSDSSFPKR

SEQ ID NO: 14277 - protein, 21 aa, Homo sapiens
SSTISVHDPFSDVSDSSFPKR

SEQ ID NO: 14278 - protein, 12 aa, Homo sapiens
HMDGMYGPPAKR

SEQ ID NO: 14279 - protein, 12 aa, Homo sapiens
HMDGMYGPPAKR

SEQ ID NO: 14280 - protein, 12 aa, Homo sapiens
IVKKNNLFVVDR

SEQ ID NO: 14281 - protein, 10 aa, Homo sapiens
QEKFYATLVR

SEQ ID NO: 14282 - protein, 10 aa, Homo sapiens
QEKFYATLVR

SEQ ID NO: 14283 - protein, 10 aa, Homo sapiens
NIKLLEDEPR

SEQ ID NO: 14284 - protein, 10 aa, Homo sapiens
NIKLLEDEPR

SEQ ID NO: 14285 - protein, 10 aa, Homo sapiens
NIKLLEDEPR

SEQ ID NO: 14286 - protein, 10 aa, Homo sapiens
NIKLLEDEPR

SEQ ID NO: 14287 - protein, 10 aa, Homo sapiens
NIKLLEDEPR

SEQ ID NO: 14288 - protein, 6 aa, Homo sapiens
KNPVCR

SEQ ID NO: 14289 - protein, 6 aa, Homo sapiens
KNPVCR

SEQ ID NO: 14290 - protein, 6 aa, Homo sapiens
KNPVCR

SEQ ID NO: 14291 - protein, 6 aa, Homo sapiens
KNPVCR

SEQ ID NO: 14292 - protein, 6 aa, Homo sapiens
KNPVCR

SEQ ID NO: 14293 - protein, 6 aa, Homo sapiens
KNPVCR

SEQ ID NO: 14294 - protein, 37 aa, Homo sapiens; identical to SEQ ID NO: 2344

SEQ ID NO: 14295 - protein, 12 aa, Homo sapiens
HMDGMYGPPAKR

SEQ ID NO: 14296 - protein, 12 aa, Homo sapiens
HMDGMYGPPAKR

SEQ ID NO: 14297 - protein, 12 aa, Homo sapiens
HMDGMYGPPAKR

SEQ ID NO: 14298 - protein, 12 aa, Homo sapiens
HMDGMYGPPAKR

SEQ ID NO: 14299 - protein, 12 aa, Homo sapiens
HMDGMYGPPAKR

SEQ ID NO: 14300 - protein, 37 aa, Homo sapiens; identical to SEQ ID NO: 2344

SEQ ID NO: 14301 - protein, 37 aa, Homo sapiens; identical to SEQ ID NO: 2344

SEQ ID NO: 14302 - protein, 37 aa, Homo sapiens; identical to SEQ ID NO: 2344

SEQ ID NO: 14303 - protein, 37 aa, Homo sapiens; identical to SEQ ID NO: 2344

SEQ ID NO: 14304 - protein, 37 aa, Homo sapiens; identical to SEQ ID NO: 2344

SEQ ID NO: 14305 - protein, 12 aa, Homo sapiens
HMDGMYGPPAKR

SEQ ID NO: 14306 - protein, 36 aa, Homo sapiens; identical to SEQ ID NO: 2345

SEQ ID NO: 14307 - protein, 37 aa, Homo sapiens; identical to SEQ ID NO: 2344

SEQ ID NO: 14308 - protein, 37 aa, Homo sapiens; identical to SEQ ID NO: 2344

SEQ ID NO: 14309 - protein, 12 aa, Homo sapiens
HMDGMYGPPAKR

SEQ ID NO: 14310 - protein, 37 aa, Homo sapiens; identical to SEQ ID NO: 2344

SEQ ID NO: 14311 - protein, 12 aa, Homo sapiens
HMDGMYGPPAKR

SEQ ID NO: 14312 - protein, 36 aa, Homo sapiens; identical to SEQ ID NO: 2345

SEQ ID NO: 14313 - protein, 12 aa, Homo sapiens
HMDGMYGPPAKR

SEQ ID NO: 14314 - protein, 6 aa, Homo sapiens
KNPVCR

SEQ ID NO: 14315 - protein, 6 aa, Homo sapiens
KNPVCR

SEQ ID NO: 14316 - protein, 6 aa, Homo sapiens
KNPVCR

SEQ ID NO: 14317 - protein, 12 aa, Homo sapiens
HMDGMYGPPAKR

SEQ ID NO: 14318 - protein, 12 aa, Homo sapiens
HMDGMYGPPAKR

SEQ ID NO: 14319 - protein, 12 aa, Homo sapiens
HMDGMYGPPAKR

SEQ ID NO: 14320 - protein, 12 aa, Homo sapiens
HMDGMYGPPAKR

SEQ ID NO: 14321 - protein, 12 aa, Homo sapiens
HMDGMYGPPAKR

SEQ ID NO: 14322 - protein, 27 aa, Homo sapiens
LVLETLCKLSIQDNNVDLILATPPFSR

SEQ ID NO: 14323 - protein, 18 aa, Homo sapiens
GVACSKDEWWWDCLEVLR

SEQ ID NO: 14324 - protein, 13 aa, Homo sapiens
APQTYEKEEDEDK

SEQ ID NO: 14325 - protein, 13 aa, Homo sapiens
APQTYEKEEDEDK

SEQ ID NO: 14326 - protein, 18 aa, Homo sapiens
GVACSKDEWWWDCLEVLR

SEQ ID NO: 14327 - protein, 18 aa, Homo sapiens
GVACSKDEWWWDCLEVLR

SEQ ID NO: 14328 - protein, 18 aa, Homo sapiens
GVACSKDEWWWDCLEVLR

SEQ ID NO: 14329 - protein, 18 aa, Homo sapiens
GVACSKDEWWWDCLEVLR

SEQ ID NO: 14330 - protein, 18 aa, Homo sapiens
GVACSKDEWWWDCLEVLR

SEQ ID NO: 14331 - protein, 18 aa, Homo sapiens
GVACSKDEWWWDCLEVLR

SEQ ID NO: 14332 - protein, 13 aa, Homo sapiens
APQTYEKEEDEDK

SEQ ID NO: 14333 - protein, 18 aa, Homo sapiens
GVACSKDEWWWDCLEVLR

SEQ ID NO: 14334 - protein, 18 aa, Homo sapiens
GVACSKDEWWWDCLEVLR

SEQ ID NO: 14335 - protein, 13 aa, Homo sapiens
APQTYEKEEDEDK

SEQ ID NO: 14336 - protein, 13 aa, Homo sapiens
APQTYEKEEDEDK

SEQ ID NO: 14337 - protein, 18 aa, Homo sapiens
GVACSKDEWWWDCLEVLR

SEQ ID NO: 14338 - protein, 9 aa, Homo sapiens
KNNLFVVDR

SEQ ID NO: 14339 - protein, 10 aa, Homo sapiens
NIKLLEDEPR

SEQ ID NO: 14340 - protein, 10 aa, Homo sapiens
NIKLLEDEPR

SEQ ID NO: 14341 - protein, 10 aa, Homo sapiens
NIKLLEDEPR

SEQ ID NO: 14342 - protein, 10 aa, Homo sapiens
NIKLLEDEPR

SEQ ID NO: 14343 - protein, 6 aa, Homo sapiens
KLWVDR

SEQ ID NO: 14344 - protein, 6 aa, Homo sapiens
KLWVDR

SEQ ID NO: 14345 - protein, 6 aa, Homo sapiens
SDKLGR

SEQ ID NO: 14346 - protein, 19 aa, Homo sapiens
EITFPPGSVEASQPVLKQR

SEQ ID NO: 14347 - protein, 20 aa, Homo sapiens
SRDETPLCTIAHWQDSLAKR

SEQ ID NO: 14348 - protein, 20 aa, Homo sapiens
SRDETPLCTIAHWQDSLAKR

SEQ ID NO: 14349 - protein, 19 aa, Homo sapiens
EITFPPGSVEASQPVLKQR

SEQ ID NO: 14350 - protein, 19 aa, Homo sapiens
EITFPPGSVEASQPVLKQR

SEQ ID NO: 14351 - protein, 19 aa, Homo sapiens
EITFPPGSVEASQPVLKQR

SEQ ID NO: 14352 - protein, 19 aa, Homo sapiens
EITFPPGSVEASQPVLKQR

SEQ ID NO: 14353 - protein, 6 aa, Homo sapiens
KNPVCR

SEQ ID NO: 14354 - protein, 14 aa, Homo sapiens
MPYEPNKDPFGGMR

SEQ ID NO: 14355 - protein, 14 aa, Homo sapiens
MPYEPNKDPFGGMR

SEQ ID NO: 14356 - protein, 12 aa, Homo sapiens
HMDGMYGPPAKR

SEQ ID NO: 14357 - protein, 12 aa, Homo sapiens
HMDGMYGPPAKR

SEQ ID NO: 14358 - protein, 14 aa, Homo sapiens
MPYEPNKDPFGGMR

SEQ ID NO: 14359 - protein, 14 aa, Homo sapiens
MPYEPNKDPFGGMR

SEQ ID NO: 14360 - protein, 14 aa, Homo sapiens
MPYEPNKDPFGGMR

SEQ ID NO: 14361 - protein, 21 aa, Homo sapiens
SGHPSCLQFTPVMMAAVKTYR

SEQ ID NO: 14362 - protein, 16 aa, Homo sapiens
KTGQPEELVSCSDCGR

SEQ ID NO: 14363 - protein, 21 aa, Homo sapiens
SGHPSCLQFTPVMMAAVKTYR

SEQ ID NO: 14364 - protein, 21 aa, Homo sapiens
SGHPSCLQFTPVMMAAVKTYR

SEQ ID NO: 14365 - protein, 16 aa, Homo sapiens
KTGQPEELVSCSDCGR

SEQ ID NO: 14366 - protein, 16 aa, Homo sapiens
KTGQPEELVSCSDCGR

SEQ ID NO: 14367 - protein, 21 aa, Homo sapiens
SGHPSCLQFTPVMMAAVKTYR

SEQ ID NO: 14368 - protein, 21 aa, Homo sapiens
SGHPSCLQFTPVMMAAVKTYR

SEQ ID NO: 14369 - protein, 16 aa, Homo sapiens
KTGQPEELVSCSDCGR

SEQ ID NO: 14370 - protein, 16 aa, Homo sapiens
KTGQPEELVSCSDCGR

SEQ ID NO: 14371 - protein, 16 aa, Homo sapiens
KTGQPEELVSCSDCGR

SEQ ID NO: 14372 - protein, 16 aa, Homo sapiens
KTGQPEELVSCSDCGR

SEQ ID NO: 14373 - protein, 21 aa, Homo sapiens
SGHPSCLQFTPVMMAAVKTYR

SEQ ID NO: 14374 - protein, 16 aa, Homo sapiens
KTGQPEELVSCSDCGR

SEQ ID NO: 14375 - protein, 16 aa, Homo sapiens
KTGQPEELVSCSDCGR

SEQ ID NO: 14376 - protein, 16 aa, Homo sapiens
KTGQPEELVSCSDCGR

SEQ ID NO: 14377 - protein, 21 aa, Homo sapiens
SGHPSCLQFTPVMMAAVKTYR

SEQ ID NO: 14378 - protein, 21 aa, Homo sapiens
SGHPSCLQFTPVMMAAVKTYR

SEQ ID NO: 14379 - protein, 21 aa, Homo sapiens
SGHPSCLQFTPVMMAAVKTYR

SEQ ID NO: 14380 - protein, 21 aa, Homo sapiens
SGHPSCLQFTPVMMAAVKTYR

SEQ ID NO: 14381 - protein, 16 aa, Homo sapiens
KTGQPEELVSCSDCGR

SEQ ID NO: 14382 - protein, 21 aa, Homo sapiens
SGHPSCLQFTPVMMAAVKTYR

SEQ ID NO: 14383 - protein, 16 aa, Homo sapiens
KTGQPEELVSCSDCGR

SEQ ID NO: 14384 - protein, 16 aa, Homo sapiens
LSFPSIKPDTDQTLKK

SEQ ID NO: 14385 - protein, 7 aa, Homo sapiens
TDPLEKR

SEQ ID NO: 14386 - protein, 16 aa, Homo sapiens
LSFPSIKPDTDQTLKK

SEQ ID NO: 14387 - protein, 16 aa, Homo sapiens
LSFPSIKPDTDQTLKK

SEQ ID NO: 14388 - protein, 15 aa, Homo sapiens
LSFPSIKPDTDQTLK

SEQ ID NO: 14389 - protein, 16 aa, Homo sapiens
LSFPSIKPDTDQTLKK

SEQ ID NO: 14390 - protein, 7 aa, Homo sapiens
TDPLEKR

SEQ ID NO: 14391 - protein, 8 aa, Homo sapiens
GKGVGSAR

SEQ ID NO: 14392 - protein, 8 aa, Homo sapiens
GKGVGSAR

SEQ ID NO: 14393 - protein, 7 aa, Homo sapiens
TDPLEKR

SEQ ID NO: 14394 - protein, 7 aa, Homo sapiens
TDPLEKR

SEQ ID NO: 14395 - protein, 7 aa, Homo sapiens
TDPLEKR

SEQ ID NO: 14396 - protein, 7 aa, Homo sapiens
TDPLEKR

SEQ ID NO: 14397 - protein, 8 aa, Homo sapiens
GKGVGSAR

SEQ ID NO: 14398 - protein, 8 aa, Homo sapiens
GKGVGSAR

SEQ ID NO: 14399 - protein, 19 aa, Homo sapiens
INKKTGQPEELVSCSDCGR

SEQ ID NO: 14400 - protein, 10 aa, Homo sapiens
SKGKGVGSAR

SEQ ID NO: 14401 - protein, 8 aa, Homo sapiens
GKGVGSAR

SEQ ID NO: 14402 - protein, 8 aa, Homo sapiens
GKGVGSAR

SEQ ID NO: 14403 - protein, 34 aa, Homo sapiens; identical to SEQ ID NO: 2351

SEQ ID NO: 14404 - protein, 8 aa, Homo sapiens
GKGVGSAR

SEQ ID NO: 14405 - protein, 21 aa, Homo sapiens
SGHPSCLQFTPVMMAAVKTYR

SEQ ID NO: 14406 - protein, 8 aa, Homo sapiens
GKGVGSAR

SEQ ID NO: 14407 - protein, 11 aa, Homo sapiens
KKLDASILEDR

SEQ ID NO: 14408 - protein, 8 aa, Homo sapiens
GKGVGSAR

SEQ ID NO: 14409 - protein, 8 aa, Homo sapiens
GKGVGSAR

SEQ ID NO: 14410 - protein, 12 aa, Homo sapiens
DKPYACDICGKR

SEQ ID NO: 14411 - protein, 12 aa, Homo sapiens
DKPYACDICGKR

SEQ ID NO: 14412 - protein, 12 aa, Homo sapiens
DKPYACDICGKR

SEQ ID NO: 14413 - protein, 7 aa, Homo sapiens
TDPLEKR

SEQ ID NO: 14414 - protein, 7 aa, Homo sapiens
TDPLEKR

SEQ ID NO: 14415 - protein, 7 aa, Homo sapiens
TDPLEKR

SEQ ID NO: 14416 - protein, 17 aa, Homo sapiens
KEGLISQDGSSLEALLR

SEQ ID NO: 14417 - protein, 17 aa, Homo sapiens
KEGLISQDGSSLEALLR

SEQ ID NO: 14418 - protein, 25 aa, Homo sapiens
PDTDQTLKKEGLISQDGSSLEALLR

SEQ ID NO: 14419 - protein, 25 aa, Homo sapiens
PDTDQTLKKEGLISQDGSSLEALLR

SEQ ID NO: 14420 - protein, 25 aa, Homo sapiens
PDTDQTLKKEGLISQDGSSLEALLR

SEQ ID NO: 14421 - protein, 17 aa, Homo sapiens
KEGLISQDGSSLEALLR

SEQ ID NO: 14422 - protein, 25 aa, Homo sapiens
PDTDQTLKKEGLISQDGSSLEALLR

SEQ ID NO: 14423 - protein, 25 aa, Homo sapiens
PDTDQTLKKEGLISQDGSSLEALLR

SEQ ID NO: 14424 - protein, 16 aa, Homo sapiens
KTGQPEELVSCSDCGR

SEQ ID NO: 14425 - protein, 16 aa, Homo sapiens
KTGQPEELVSCSDCGR

SEQ ID NO: 14426 - protein, 16 aa, Homo sapiens
KTGQPEELVSCSDCGR

SEQ ID NO: 14427 - protein, 16 aa, Homo sapiens
KTGQPEELVSCSDCGR

SEQ ID NO: 14428 - protein, 16 aa, Homo sapiens
KTGQPEELVSCSDCGR

SEQ ID NO: 14429 - protein, 7 aa, Homo sapiens
SEEQKSK

SEQ ID NO: 14430 - protein, 7 aa, Homo sapiens
SEEQKSK

SEQ ID NO: 14431 - protein, 34 aa, Homo sapiens; identical to SEQ ID NO: 2351

SEQ ID NO: 14432 - protein, 34 aa, Homo sapiens; identical to SEQ ID NO: 2351

SEQ ID NO: 14433 - protein, 7 aa, Homo sapiens
SEEQKSK

SEQ ID NO: 14434 - protein, 24 aa, Homo sapiens
LPFLDSQTGVAQSNCYIWMEKRHR

SEQ ID NO: 14435 - protein, 24 aa, Homo sapiens
LPFLDSQTGVAQSNCYIWMEKRHR

SEQ ID NO: 14436 - protein, 21 aa, Homo sapiens
KGPDGLALPNNYCDFCLGDSK

SEQ ID NO: 14437 - protein, 16 aa, Homo sapiens
KTGQPEELVSCSDCGR

SEQ ID NO: 14438 - protein, 7 aa, Homo sapiens
SEEQKSK

SEQ ID NO: 14439 - protein, 7 aa, Homo sapiens
SEEQKSK

SEQ ID NO: 14440 - protein, 7 aa, Homo sapiens
SEEQKSK

SEQ ID NO: 14441 - protein, 7 aa, Homo sapiens
SEEQKSK

SEQ ID NO: 14442 - protein, 7 aa, Homo sapiens
SEEQKSK

SEQ ID NO: 14443 - protein, 7 aa, Homo sapiens
SEEQKSK

SEQ ID NO: 14444 - protein, 7 aa, Homo sapiens
SEEQKSK

SEQ ID NO: 14445 - protein, 7 aa, Homo sapiens
SEEQKSK

SEQ ID NO: 14446 - protein, 7 aa, Homo sapiens
SEEQKSK

SEQ ID NO: 14447 - protein, 21 aa, Homo sapiens
KGPDGLALPNNYCDFCLGDSK

SEQ ID NO: 14448 - protein, 7 aa, Homo sapiens
SEEQKSK

SEQ ID NO: 14449 - protein, 21 aa, Homo sapiens
KGPDGLALPNNYCDFCLGDSK

SEQ ID NO: 14450 - protein, 7 aa, Homo sapiens
SEEQKSK

SEQ ID NO: 14451 - protein, 21 aa, Homo sapiens
KGPDGLALPNNYCDFCLGDSK

SEQ ID NO: 14452 - protein, 7 aa, Homo sapiens
SEEQKSK

SEQ ID NO: 14453 - protein, 21 aa, Homo sapiens
SGHPSCLQFTPVMMAAVKTYR

SEQ ID NO: 14454 - protein, 21 aa, Homo sapiens
SGHPSCLQFTPVMMAAVKTYR

SEQ ID NO: 14455 - protein, 21 aa, Homo sapiens
SGHPSCLQFTPVMMAAVKTYR

SEQ ID NO: 14456 - protein, 8 aa, Homo sapiens
GKGVGSAR

SEQ ID NO: 14457 - protein, 8 aa, Homo sapiens
GKGVGSAR

SEQ ID NO: 14458 - protein, 10 aa, Homo sapiens
SKGKGVGSAR

SEQ ID NO: 14459 - protein, 8 aa, Homo sapiens
GKGVGSAR

SEQ ID NO: 14460 - protein, 8 aa, Homo sapiens
GKGVGSAR

SEQ ID NO: 14461 - protein, 23 aa, Homo sapiens
ILEPDDFLDDLDDEDYEEDTPKR

SEQ ID NO: 14462 - protein, 8 aa, Homo sapiens
GKGVGSAR

SEQ ID NO: 14463 - protein, 4 aa, Homo sapiens
SKGK

SEQ ID NO: 14464 - protein, 24 aa, Homo sapiens
ILEPDDFLDDLDDEDYEEDTPKRR

SEQ ID NO: 14465 - protein, 24 aa, Homo sapiens
ILEPDDFLDDLDDEDYEEDTPKRR

SEQ ID NO: 14466 - protein, 11 aa, Homo sapiens
KKLDASILEDR

SEQ ID NO: 14467 - protein, 11 aa, Homo sapiens
KKLDASILEDR

SEQ ID NO: 14468 - protein, 24 aa, Homo sapiens
ILEPDDFLDDLDDEDYEEDTPKRR

SEQ ID NO: 14469 - protein, 5 aa, Homo sapiens
RGKGK

SEQ ID NO: 14470 - protein, 5 aa, Homo sapiens
RGKGK

SEQ ID NO: 14471 - protein, 5 aa, Homo sapiens
RGKGK

SEQ ID NO: 14472 - protein, 5 aa, Homo sapiens
RGKGK

SEQ ID NO: 14473 - protein, 6 aa, Homo sapiens
GKGKSK

SEQ ID NO: 14474 - protein, 6 aa, Homo sapiens
GKGKSK

SEQ ID NO: 14475 - protein, 15 aa, Homo sapiens
LSFPSIKPDTDQTLK

SEQ ID NO: 14476 - protein, 15 aa, Homo sapiens
LSFPSIKPDTDQTLK

SEQ ID NO: 14477 - protein, 7 aa, Homo sapiens
SEEQKSK

SEQ ID NO: 14478 - protein, 15 aa, Homo sapiens
LSFPSIKPDTDQTLK

SEQ ID NO: 14479 - protein, 15 aa, Homo sapiens
LSFPSIKPDTDQTLK

SEQ ID NO: 14480 - protein, 15 aa, Homo sapiens
LSFPSIKPDTDQTLK

SEQ ID NO: 14481 - protein, 15 aa, Homo sapiens
LSFPSIKPDTDQTLK

SEQ ID NO: 14482 - protein, 15 aa, Homo sapiens
LSFPSIKPDTDQTLK

SEQ ID NO: 14483 - protein, 15 aa, Homo sapiens
LSFPSIKPDTDQTLK

SEQ ID NO: 14484 - protein, 15 aa, Homo sapiens
LSFPSIKPDTDQTLK

SEQ ID NO: 14485 - protein, 15 aa, Homo sapiens
LSFPSIKPDTDQTLK

SEQ ID NO: 14486 - protein, 15 aa, Homo sapiens
LSFPSIKPDTDQTLK

SEQ ID NO: 14487 - protein, 15 aa, Homo sapiens
LSFPSIKPDTDQTLK

SEQ ID NO: 14488 - protein, 17 aa, Homo sapiens
KEGLISQDGSSLEALLR

SEQ ID NO: 14489 - protein, 15 aa, Homo sapiens
LSFPSIKPDTDQTLK

SEQ ID NO: 14490 - protein, 15 aa, Homo sapiens
LSFPSIKPDTDQTLK

SEQ ID NO: 14491 - protein, 17 aa, Homo sapiens
KEGLISQDGSSLEALLR

SEQ ID NO: 14492 - protein, 17 aa, Homo sapiens
KEGLISQDGSSLEALLR

SEQ ID NO: 14493 - protein, 16 aa, Homo sapiens
LSFPSIKPDTDQTLKK

SEQ ID NO: 14494 - protein, 17 aa, Homo sapiens
KEGLISQDGSSLEALLR

SEQ ID NO: 14495 - protein, 15 aa, Homo sapiens
LSFPSIKPDTDQTLK

SEQ ID NO: 14496 - protein, 15 aa, Homo sapiens
LSFPSIKPDTDQTLK

SEQ ID NO: 14497 - protein, 17 aa, Homo sapiens
KEGLISQDGSSLEALLR

SEQ ID NO: 14498 - protein, 17 aa, Homo sapiens
KEGLISQDGSSLEALLR

SEQ ID NO: 14499 - protein, 17 aa, Homo sapiens
KEGLISQDGSSLEALLR

SEQ ID NO: 14500 - protein, 15 aa, Homo sapiens
LSFPSIKPDTDQTLK

SEQ ID NO: 14501 - protein, 17 aa, Homo sapiens
KEGLISQDGSSLEALLR

SEQ ID NO: 14502 - protein, 17 aa, Homo sapiens
KEGLISQDGSSLEALLR

SEQ ID NO: 14503 - protein, 17 aa, Homo sapiens
KEGLISQDGSSLEALLR

SEQ ID NO: 14504 - protein, 17 aa, Homo sapiens
KEGLISQDGSSLEALLR

SEQ ID NO: 14505 - protein, 15 aa, Homo sapiens
LSFPSIKPDTDQTLK

SEQ ID NO: 14506 - protein, 17 aa, Homo sapiens
KEGLISQDGSSLEALLR

SEQ ID NO: 14507 - protein, 17 aa, Homo sapiens
KEGLISQDGSSLEALLR

SEQ ID NO: 14508 - protein, 17 aa, Homo sapiens
KEGLISQDGSSLEALLR

SEQ ID NO: 14509 - protein, 17 aa, Homo sapiens
KEGLISQDGSSLEALLR

SEQ ID NO: 14510 - protein, 17 aa, Homo sapiens
KEGLISQDGSSLEALLR

SEQ ID NO: 14511 - protein, 7 aa, Homo sapiens
TDPLEKR

SEQ ID NO: 14512 - protein, 7 aa, Homo sapiens
TDPLEKR

SEQ ID NO: 14513 - protein, 7 aa, Homo sapiens
TDPLEKR

SEQ ID NO: 14514 - protein, 7 aa, Homo sapiens
TDPLEKR

SEQ ID NO: 14515 - protein, 7 aa, Homo sapiens
TDPLEKR

SEQ ID NO: 14516 - protein, 7 aa, Homo sapiens
TDPLEKR

SEQ ID NO: 14517 - protein, 7 aa, Homo sapiens
TDPLEKR

SEQ ID NO: 14518 - protein, 7 aa, Homo sapiens
TDPLEKR

SEQ ID NO: 14519 - protein, 17 aa, Homo sapiens
KEGLISQDGSSLEALLR

SEQ ID NO: 14520 - protein, 7 aa, Homo sapiens
TDPLEKR

SEQ ID NO: 14521 - protein, 8 aa, Homo sapiens
KLDQTIMR

SEQ ID NO: 14522 - protein, 11 aa, Homo sapiens
VEGKLLDDPSK

SEQ ID NO: 14523 - protein, 21 aa, Homo sapiens
TPTTQETDGFQVKRPGDLSVR

SEQ ID NO: 14524 - protein, 20 aa, Homo sapiens
YLAFTEEKAMGMTNLPAVGR

SEQ ID NO: 14525 - protein, 7 aa, Homo sapiens
KPLDLYR

SEQ ID NO: 14526 - protein, 11 aa, Homo sapiens
KSSSSTTTNEK

SEQ ID NO: 14527 - protein, 7 aa, Homo sapiens
KPLDLYR

SEQ ID NO: 14528 - protein, 7 aa, Homo sapiens
KPLDLYR

SEQ ID NO: 14529 - protein, 7 aa, Homo sapiens
KPLDLYR

SEQ ID NO: 14530 - protein, 7 aa, Homo sapiens
KPLDLYR

SEQ ID NO: 14531 - protein, 7 aa, Homo sapiens
KPLDLYR

SEQ ID NO: 14532 - protein, 7 aa, Homo sapiens
KPLDLYR

SEQ ID NO: 14533 - protein, 7 aa, Homo sapiens
KPLDLYR

SEQ ID NO: 14534 - protein, 7 aa, Homo sapiens
KPLDLYR

SEQ ID NO: 14535 - protein, 7 aa, Homo sapiens
KPLDLYR

SEQ ID NO: 14536 - protein, 7 aa, Homo sapiens
KPLDLYR

SEQ ID NO: 14537 - protein, 7 aa, Homo sapiens
KPLDLYR

SEQ ID NO: 14538 - protein, 7 aa, Homo sapiens
KPLDLYR

SEQ ID NO: 14539 - protein, 7 aa, Homo sapiens
KPLDLYR

SEQ ID NO: 14540 - protein, 7 aa, Homo sapiens
KPLDLYR

SEQ ID NO: 14541 - protein, 7 aa, Homo sapiens
KPLDLYR

SEQ ID NO: 14542 - protein, 7 aa, Homo sapiens
KPLDLYR

SEQ ID NO: 14543 - protein, 7 aa, Homo sapiens
KPLDLYR

SEQ ID NO: 14544 - protein, 6 aa, Homo sapiens
KMWVDR

SEQ ID NO: 14545 - protein, 6 aa, Homo sapiens
KMWVDR

SEQ ID NO: 14546 - protein, 13 aa, Homo sapiens
ITKLYELGGEPER

SEQ ID NO: 14547 - protein, 6 aa, Homo sapiens
KMWVDR

SEQ ID NO: 14548 - protein, 10 aa, Homo sapiens
LEKLYSTMVR

SEQ ID NO: 14549 - protein, 10 aa, Homo sapiens
LEKLYSTMVR

SEQ ID NO: 14550 - protein, 29 aa, Homo sapiens
NIKILEDEPHSKDETPLCTLLDWQDSLAK

SEQ ID NO: 14551 - protein, 11 aa, Homo sapiens
LILLHHKHPER

SEQ ID NO: 14552 - protein, 12 aa, Homo sapiens
LILLHHKHPERK

SEQ ID NO: 14553 - protein, 11 aa, Homo sapiens
LILLHHKHPER

SEQ ID NO: 14554 - protein, 27 aa, Homo sapiens
KHVTTAEGTPGTTDQEGPPPDGPPEKR

SEQ ID NO: 14555 - protein, 11 aa, Homo sapiens
LILLHHKHPER

SEQ ID NO: 14556 - protein, 27 aa, Homo sapiens
KHVTTAEGTPGTTDQEGPPPDGPPEKR

SEQ ID NO: 14557 - protein, 27 aa, Homo sapiens
KHVTTAEGTPGTTDQEGPPPDGPPEKR

SEQ ID NO: 14558 - protein, 10 aa, Homo sapiens
SSEAIKESSK

SEQ ID NO: 14559 - protein, 10 aa, Homo sapiens
SSEAIKESSK

SEQ ID NO: 14560 - protein, 22 aa, Homo sapiens
SSEAIKESSKFPFGISPAQSHR

SEQ ID NO: 14561 - protein, 10 aa, Homo sapiens
SSEAIKESSK

SEQ ID NO: 14562 - protein, 10 aa, Homo sapiens
SSEAIKESSK

SEQ ID NO: 14563 - protein, 34 aa, Homo sapiens; identical to SEQ ID NO: 1943

SEQ ID NO: 14564 - protein, 34 aa, Homo sapiens; identical to SEQ ID NO: 1943

SEQ ID NO: 14565 - protein, 20 aa, Homo sapiens
CLIEIFGILKEYEVGDPGQR

SEQ ID NO: 14566 - protein, 20 aa, Homo sapiens
CLIEIFGILKEYEVGDPGQR

SEQ ID NO: 14567 - protein, 20 aa, Homo sapiens
CLIEIFGILKEYEVGDPGQR

SEQ ID NO: 14568 - protein, 10 aa, Homo sapiens
LEKLYSTMVR

SEQ ID NO: 14569 - protein, 29 aa, Homo sapiens
NIKILEDEPHSKDETPLCTLLDWQDSLAK

SEQ ID NO: 14570 - protein, 10 aa, Homo sapiens
LEKLYSTMVR

SEQ ID NO: 14571 - protein, 10 aa, Homo sapiens
LEKLYSTMVR

SEQ ID NO: 14572 - protein, 29 aa, Homo sapiens
NIKILEDEPHSKDETPLCTLLDWQDSLAK

SEQ ID NO: 14573 - protein, 10 aa, Homo sapiens
LEKLYSTMVR

SEQ ID NO: 14574 - protein, 10 aa, Homo sapiens
LEKLYSTMVR

SEQ ID NO: 14575 - protein, 29 aa, Homo sapiens
NIKILEDEPHSKDETPLCTLLDWQDSLAK

SEQ ID NO: 14576 - protein, 29 aa, Homo sapiens
NIKILEDEPHSKDETPLCTLLDWQDSLAK

SEQ ID NO: 14577 - protein, 10 aa, Homo sapiens
LEKLYSTMVR

SEQ ID NO: 14578 - protein, 10 aa, Homo sapiens
LEKLYSTMVR

SEQ ID NO: 14579 - protein, 10 aa, Homo sapiens
LEKLYSTMVR

SEQ ID NO: 14580 - protein, 10 aa, Homo sapiens
LEKLYSTMVR

SEQ ID NO: 14581 - protein, 10 aa, Homo sapiens
LEKLYSTMVR

SEQ ID NO: 14582 - protein, 29 aa, Homo sapiens
NIKILEDEPHSKDETPLCTLLDWQDSLAK

SEQ ID NO: 14583 - protein, 10 aa, Homo sapiens
LEKLYSTMVR

SEQ ID NO: 14584 - protein, 10 aa, Homo sapiens
LEKLYSTMVR

SEQ ID NO: 14585 - protein, 29 aa, Homo sapiens
NIKILEDEPHSKDETPLCTLLDWQDSLAK

SEQ ID NO: 14586 - protein, 10 aa, Homo sapiens
LEKLYSTMVR

SEQ ID NO: 14587 - protein, 10 aa, Homo sapiens
LEKLYSTMVR

SEQ ID NO: 14588 - protein, 10 aa, Homo sapiens
LEKLYSTMVR

SEQ ID NO: 14589 - protein, 10 aa, Homo sapiens
LEKLYSTMVR

SEQ ID NO: 14590 - protein, 12 aa, Homo sapiens
LILLHHKHPERK

SEQ ID NO: 14591 - protein, 12 aa, Homo sapiens
LILLHHKHPERK

SEQ ID NO: 14592 - protein, 11 aa, Homo sapiens
LILLHHKHPER

SEQ ID NO: 14593 - protein, 12 aa, Homo sapiens
NIKILEDEPHSK

SEQ ID NO: 14594 - protein, 12 aa, Homo sapiens
NIKILEDEPHSK

SEQ ID NO: 14595 - protein, 12 aa, Homo sapiens
NIKILEDEPHSK

SEQ ID NO: 14596 - protein, 12 aa, Homo sapiens
LILLHHKHPERK

SEQ ID NO: 14597 - protein, 11 aa, Homo sapiens
LILLHHKHPER

SEQ ID NO: 14598 - protein, 12 aa, Homo sapiens
NIKILEDEPHSK

SEQ ID NO: 14599 - protein, 11 aa, Homo sapiens
LILLHHKHPER

SEQ ID NO: 14600 - protein, 12 aa, Homo sapiens
LILLHHKHPERK

SEQ ID NO: 14601 - protein, 7 aa, Homo sapiens
FDKLPVK

SEQ ID NO: 14602 - protein, 7 aa, Homo sapiens
FDKLPVK

SEQ ID NO: 14603 - protein, 7 aa, Homo sapiens
FDKLPVK

SEQ ID NO: 14604 - protein, 7 aa, Homo sapiens
KPLDLYR

SEQ ID NO: 14605 - protein, 7 aa, Homo sapiens
KPLDLYR

SEQ ID NO: 14606 - protein, 7 aa, Homo sapiens
KPLDLYR

SEQ ID NO: 14607 - protein, 7 aa, Homo sapiens
KPLDLYR

SEQ ID NO: 14608 - protein, 7 aa, Homo sapiens
KPLDLYR

SEQ ID NO: 14609 - protein, 14 aa, Homo sapiens
MSYEPNKDPYGSMR

SEQ ID NO: 14610 - protein, 7 aa, Homo sapiens
KPLDLYR

SEQ ID NO: 14611 - protein, 7 aa, Homo sapiens
KPLDLYR

SEQ ID NO: 14612 - protein, 7 aa, Homo sapiens
KPLDLYR

SEQ ID NO: 14613 - protein, 7 aa, Homo sapiens
KPLDLYR

SEQ ID NO: 14614 - protein, 22 aa, Homo sapiens
SSEAIKESSKFPFGISPAQSHR

SEQ ID NO: 14615 - protein, 27 aa, Homo sapiens
KHVTTAEGTPGTTDQEGPPPDGPPEKR

SEQ ID NO: 14616 - protein, 27 aa, Homo sapiens
KHVTTAEGTPGTTDQEGPPPDGPPEKR

SEQ ID NO: 14617 - protein, 11 aa, Homo sapiens
LILLHHKHPER

SEQ ID NO: 14618 - protein, 27 aa, Homo sapiens
KHVTTAEGTPGTTDQEGPPPDGPPEKR

SEQ ID NO: 14619 - protein, 11 aa, Homo sapiens
LILLHHKHPER

SEQ ID NO: 14620 - protein, 27 aa, Homo sapiens
KHVTTAEGTPGTTDQEGPPPDGPPEKR

SEQ ID NO: 14621 - protein, 11 aa, Homo sapiens
LILLHHKHPER

SEQ ID NO: 14622 - protein, 27 aa, Homo sapiens
KHVTTAEGTPGTTDQEGPPPDGPPEKR

SEQ ID NO: 14623 - protein, 27 aa, Homo sapiens
KHVTTAEGTPGTTDQEGPPPDGPPEKR

SEQ ID NO: 14624 - protein, 27 aa, Homo sapiens
KHVTTAEGTPGTTDQEGPPPDGPPEKR

SEQ ID NO: 14625 - protein, 27 aa, Homo sapiens
KHVTTAEGTPGTTDQEGPPPDGPPEKR

SEQ ID NO: 14626 - protein, 27 aa, Homo sapiens
KHVTTAEGTPGTTDQEGPPPDGPPEKR

SEQ ID NO: 14627 - protein, 11 aa, Homo sapiens
LILLHHKHPER

SEQ ID NO: 14628 - protein, 29 aa, Homo sapiens
NIKILEDEPHSKDETPLCTLLDWQDSLAK

SEQ ID NO: 14629 - protein, 29 aa, Homo sapiens
NIKILEDEPHSKDETPLCTLLDWQDSLAK

SEQ ID NO: 14630 - protein, 29 aa, Homo sapiens
NIKILEDEPHSKDETPLCTLLDWQDSLAK

SEQ ID NO: 14631 - protein, 27 aa, Homo sapiens
KHVTTAEGTPGTTDQEGPPPDGPPEKR

SEQ ID NO: 14632 - protein, 16 aa, Homo sapiens
SSTLTEDGAKSSEAIK

SEQ ID NO: 14633 - protein, 16 aa, Homo sapiens
SSTLTEDGAKSSEAIK

SEQ ID NO: 14634 - protein, 20 aa, Homo sapiens
SSTLTEDGAKSSEAIKESSK

SEQ ID NO: 14635 - protein, 27 aa, Homo sapiens
KHVTTAEGTPGTTDQEGPPPDGPPEKR

SEQ ID NO: 14636 - protein, 14 aa, Homo sapiens
MSYEPNKDPYGSMR

SEQ ID NO: 14637 - protein, 25 aa, Homo sapiens
KAPGSDPFMSSGQGPNGGMGDPYSR

SEQ ID NO: 14638 - protein, 25 aa, Homo sapiens
KAPGSDPFMSSGQGPNGGMGDPYSR

SEQ ID NO: 14639 - protein, 14 aa, Homo sapiens
MSYEPNKDPYGSMR

SEQ ID NO: 14640 - protein, 14 aa, Homo sapiens
MSYEPNKDPYGSMR

SEQ ID NO: 14641 - protein, 25 aa, Homo sapiens
KAPGSDPFMSSGQGPNGGMGDPYSR

SEQ ID NO: 14642 - protein, 25 aa, Homo sapiens
KAPGSDPFMSSGQGPNGGMGDPYSR

SEQ ID NO: 14643 - protein, 25 aa, Homo sapiens
KAPGSDPFMSSGQGPNGGMGDPYSR

SEQ ID NO: 14644 - protein, 25 aa, Homo sapiens
KAPGSDPFMSSGQGPNGGMGDPYSR

SEQ ID NO: 14645 - protein, 25 aa, Homo sapiens
KAPGSDPFMSSGQGPNGGMGDPYSR

SEQ ID NO: 14646 - protein, 25 aa, Homo sapiens
KAPGSDPFMSSGQGPNGGMGDPYSR

SEQ ID NO: 14647 - protein, 25 aa, Homo sapiens
KAPGSDPFMSSGQGPNGGMGDPYSR

SEQ ID NO: 14648 - protein, 25 aa, Homo sapiens
KAPGSDPFMSSGQGPNGGMGDPYSR

SEQ ID NO: 14649 - protein, 25 aa, Homo sapiens
KAPGSDPFMSSGQGPNGGMGDPYSR

SEQ ID NO: 14650 - protein, 25 aa, Homo sapiens
KAPGSDPFMSSGQGPNGGMGDPYSR

SEQ ID NO: 14651 - protein, 14 aa, Homo sapiens
MSYEPNKDPYGSMR

SEQ ID NO: 14652 - protein, 14 aa, Homo sapiens
MSYEPNKDPYGSMR

SEQ ID NO: 14653 - protein, 13 aa, Homo sapiens
LTMKDIGTPEAWR

SEQ ID NO: 14654 - protein, 13 aa, Homo sapiens
LTMKDIGTPEAWR

SEQ ID NO: 14655 - protein, 18 aa, Homo sapiens
IVQKNDPFVVDCSDKLGR

SEQ ID NO: 14656 - protein, 34 aa, Homo sapiens; identical to SEQ ID NO: 1943

SEQ ID NO: 14657 - protein, 29 aa, Homo sapiens
NIKILEDEPHSKDETPLCTLLDWQDSLAK

SEQ ID NO: 14658 - protein, 11 aa, Homo sapiens
LILLHHKHPER

SEQ ID NO: 14659 - protein, 29 aa, Homo sapiens
NIKILEDEPHSKDETPLCTLLDWQDSLAK

SEQ ID NO: 14660 - protein, 10 aa, Homo sapiens
LEKLYSTMVR

SEQ ID NO: 14661 - protein, 10 aa, Homo sapiens
LEKLYSTMVR

SEQ ID NO: 14662 - protein, 29 aa, Homo sapiens
NIKILEDEPHSKDETPLCTLLDWQDSLAK

SEQ ID NO: 14663 - protein, 9 aa, Homo sapiens
KQAPLTYEK

SEQ ID NO: 14664 - protein, 14 aa, Homo sapiens
RLTMKDIGTPEAWR

SEQ ID NO: 14665 - protein, 16 aa, Homo sapiens
SSTLTEDGAKSSEAIK

SEQ ID NO: 14666 - protein, 16 aa, Homo sapiens
SSTLTEDGAKSSEAIK

SEQ ID NO: 14667 - protein, 16 aa, Homo sapiens
ESSKFPFGISPAQSHR

SEQ ID NO: 14668 - protein, 16 aa, Homo sapiens
ESSKFPFGISPAQSHR

SEQ ID NO: 14669 - protein, 16 aa, Homo sapiens
SSTLTEDGAKSSEAIK

SEQ ID NO: 14670 - protein, 16 aa, Homo sapiens
ESSKFPFGISPAQSHR

SEQ ID NO: 14671 - protein, 16 aa, Homo sapiens
ESSKFPFGISPAQSHR

SEQ ID NO: 14672 - protein, 16 aa, Homo sapiens
SSTLTEDGAKSSEAIK

SEQ ID NO: 14673 - protein, 16 aa, Homo sapiens
ESSKFPFGISPAQSHR

SEQ ID NO: 14674 - protein, 16 aa, Homo sapiens
SSTLTEDGAKSSEAIK

SEQ ID NO: 14675 - protein, 16 aa, Homo sapiens
SSTLTEDGAKSSEAIK

SEQ ID NO: 14676 - protein, 16 aa, Homo sapiens
SSTLTEDGAKSSEAIK

SEQ ID NO: 14677 - protein, 14 aa, Homo sapiens
MSYEPNKDPYGSMR

SEQ ID NO: 14678 - protein, 14 aa, Homo sapiens
MSYEPNKDPYGSMR

SEQ ID NO: 14679 - protein, 14 aa, Homo sapiens
MSYEPNKDPYGSMR

SEQ ID NO: 14680 - protein, 14 aa, Homo sapiens
MSYEPNKDPYGSMR

SEQ ID NO: 14681 - protein, 21 aa, Homo sapiens
SNSVGIQDAFNDGSDSTFQKR

SEQ ID NO: 14682 - protein, 14 aa, Homo sapiens
MSYEPNKDPYGSMR

SEQ ID NO: 14683 - protein, 14 aa, Homo sapiens
MSYEPNKDPYGSMR

SEQ ID NO: 14684 - protein, 21 aa, Homo sapiens
SNSVGIQDAFNDGSDSTFQKR

SEQ ID NO: 14685 - protein, 14 aa, Homo sapiens
MSYEPNKDPYGSMR

SEQ ID NO: 14686 - protein, 14 aa, Homo sapiens
MSYEPNKDPYGSMR

SEQ ID NO: 14687 - protein, 25 aa, Homo sapiens
KAPGSDPFMSSGQGPNGGMGDPYSR

SEQ ID NO: 14688 - protein, 21 aa, Homo sapiens
SNSVGIQDAFNDGSDSTFQKR

SEQ ID NO: 14689 - protein, 6 aa, Homo sapiens
KMWVDR

SEQ ID NO: 14690 - protein, 6 aa, Homo sapiens
KMWVDR

SEQ ID NO: 14691 - protein, 24 aa, Homo sapiens
SLSFVPGNDFEMSKHPGLLLILGK

SEQ ID NO: 14692 - protein, 24 aa, Homo sapiens
SLSFVPGNDFEMSKHPGLLLILGK

SEQ ID NO: 14693 - protein, 11 aa, Homo sapiens
LILLHHKHPER

SEQ ID NO: 14694 - protein, 12 aa, Homo sapiens
LILLHHKHPERK

SEQ ID NO: 14695 - protein, 24 aa, Homo sapiens
SLSFVPGNDFEMSKHPGLLLILGK

SEQ ID NO: 14696 - protein, 11 aa, Homo sapiens
LILLHHKHPER

SEQ ID NO: 14697 - protein, 11 aa, Homo sapiens
LILLHHKHPER

SEQ ID NO: 14698 - protein, 11 aa, Homo sapiens
LILLHHKHPER

SEQ ID NO: 14699 - protein, 11 aa, Homo sapiens
LILLHHKHPER

SEQ ID NO: 14700 - protein, 11 aa, Homo sapiens
LILLHHKHPER

SEQ ID NO: 14701 - protein, 24 aa, Homo sapiens
SLSFVPGNDFEMSKHPGLLLILGK

SEQ ID NO: 14702 - protein, 11 aa, Homo sapiens
LILLHHKHPER

SEQ ID NO: 14703 - protein, 11 aa, Homo sapiens
LILLHHKHPER

SEQ ID NO: 14704 - protein, 11 aa, Homo sapiens
LILLHHKHPER

SEQ ID NO: 14705 - protein, 11 aa, Homo sapiens
LILLHHKHPER

SEQ ID NO: 14706 - protein, 11 aa, Homo sapiens
LILLHHKHPER

SEQ ID NO: 14707 - protein, 10 aa, Homo sapiens
ADGTPKTESK

SEQ ID NO: 14708 - protein, 14 aa, Homo sapiens
KSSSSTTTNEKITK

SEQ ID NO: 14709 - protein, 6 aa, Homo sapiens
KMWVDR

SEQ ID NO: 14710 - protein, 6 aa, Homo sapiens
KMWVDR

SEQ ID NO: 14711 - protein, 10 aa, Homo sapiens
LEKLYSTMVR

SEQ ID NO: 14712 - protein, 16 aa, Homo sapiens
ESSKFPFGISPAQSHR

SEQ ID NO: 14713 - protein, 12 aa, Homo sapiens
LILLHHKHPERK

SEQ ID NO: 14714 - protein, 11 aa, Homo sapiens
LILLHHKHPER

SEQ ID NO: 14715 - protein, 11 aa, Homo sapiens
LILLHHKHPER

SEQ ID NO: 14716 - protein, 11 aa, Homo sapiens
LILLHHKHPER

SEQ ID NO: 14717 - protein, 11 aa, Homo sapiens
LILLHHKHPER

SEQ ID NO: 14718 - protein, 11 aa, Homo sapiens
LILLHHKHPER

SEQ ID NO: 14719 - protein, 34 aa, Homo sapiens; identical to SEQ ID NO: 1943

SEQ ID NO: 14720 - protein, 27 aa, Homo sapiens
KHVTTAEGTPGTTDQEGPPPDGPPEKR

SEQ ID NO: 14721 - protein, 27 aa, Homo sapiens
KHVTTAEGTPGTTDQEGPPPDGPPEKR

SEQ ID NO: 14722 - protein, 7 aa, Homo sapiens
KAEQQQR

SEQ ID NO: 14723 - protein, 22 aa, Homo sapiens
KAEQQQREEAGGEAAAAAAAER

SEQ ID NO: 14724 - protein, 24 aa, Homo sapiens
GEMKAAAGQESEGPAVGPPQPLGK

SEQ ID NO: 14725 - protein, 22 aa, Homo sapiens
KAEQQQREEAGGEAAAAAAAER

SEQ ID NO: 14726 - protein, 7 aa, Homo sapiens
KAEQQQR

SEQ ID NO: 14727 - protein, 24 aa, Homo sapiens
GEMKAAAGQESEGPAVGPPQPLGK

SEQ ID NO: 14728 - protein, 7 aa, Homo sapiens
KAEQQQR

SEQ ID NO: 14729 - protein, 7 aa, Homo sapiens
KAEQQQR

SEQ ID NO: 14730 - protein, 21 aa, Homo sapiens
VAPEEHPVLLTEAPLNPKANR

SEQ ID NO: 14731 - protein, 21 aa, Homo sapiens
VAPEEHPVLLTEAPLNPKANR

SEQ ID NO: 14732 - protein, 21 aa, Homo sapiens
VAPEEHPVLLTEAPLNPKANR

SEQ ID NO: 14733 - protein, 21 aa, Homo sapiens
VAPEEHPVLLTEAPLNPKANR

SEQ ID NO: 14734 - protein, 21 aa, Homo sapiens
VAPEEHPVLLTEAPLNPKANR

SEQ ID NO: 14735 - protein, 21 aa, Homo sapiens
VAPEEHPVLLTEAPLNPKANR

SEQ ID NO: 14736 - protein, 9 aa, Homo sapiens
EIVRDIKEK

SEQ ID NO: 14737 - protein, 9 aa, Homo sapiens
EIVRDIKEK

SEQ ID NO: 14738 - protein, 21 aa, Homo sapiens
VAPEEHPVLLTEAPLNPKANR

SEQ ID NO: 14739 - protein, 22 aa, Homo sapiens
KDLYANTVLSGGTTMYPGIADR

SEQ ID NO: 14740 - protein, 22 aa, Homo sapiens
KDLYANTVLSGGTTMYPGIADR

SEQ ID NO: 14741 - protein, 22 aa, Homo sapiens
KDLYANTVLSGGTTMYPGIADR

SEQ ID NO: 14742 - protein, 22 aa, Homo sapiens
KDLYANTVLSGGTTMYPGIADR

SEQ ID NO: 14743 - protein, 22 aa, Homo sapiens
KDLYANTVLSGGTTMYPGIADR

SEQ ID NO: 14744 - protein, 22 aa, Homo sapiens
KDLYANTVLSGGTTMYPGIADR

SEQ ID NO: 14745 - protein, 22 aa, Homo sapiens
KDLYANTVLSGGTTMYPGIADR

SEQ ID NO: 14746 - protein, 22 aa, Homo sapiens
KDLYANTVLSGGTTMYPGIADR

SEQ ID NO: 14747 - protein, 22 aa, Homo sapiens
KDLYANTVLSGGTTMYPGIADR

SEQ ID NO: 14748 - protein, 22 aa, Homo sapiens
KDLYANTVLSGGTTMYPGIADR

SEQ ID NO: 14749 - protein, 22 aa, Homo sapiens
KDLYANTVLSGGTTMYPGIADR

SEQ ID NO: 14750 - protein, 22 aa, Homo sapiens
KDLYANTVLSGGTTMYPGIADR

SEQ ID NO: 14751 - protein, 22 aa, Homo sapiens
KDLYANTVLSGGTTMYPGIADR

SEQ ID NO: 14752 - protein, 22 aa, Homo sapiens
KDLYANTVLSGGTTMYPGIADR

SEQ ID NO: 14753 - protein, 22 aa, Homo sapiens
KDLYANTVLSGGTTMYPGIADR

SEQ ID NO: 14754 - protein, 22 aa, Homo sapiens
KDLYANTVLSGGTTMYPGIADR

SEQ ID NO: 14755 - protein, 22 aa, Homo sapiens
KDLYANTVLSGGTTMYPGIADR

SEQ ID NO: 14756 - protein, 22 aa, Homo sapiens
KDLYANTVLSGGTTMYPGIADR

SEQ ID NO: 14757 - protein, 22 aa, Homo sapiens
KDLYANTVLSGGTTMYPGIADR

SEQ ID NO: 14758 - protein, 22 aa, Homo sapiens
KDLYANTVLSGGTTMYPGIADR

SEQ ID NO: 14759 - protein, 22 aa, Homo sapiens
KDLYANTVLSGGTTMYPGIADR

SEQ ID NO: 14760 - protein, 22 aa, Homo sapiens
KDLYANTVLSGGTTMYPGIADR

SEQ ID NO: 14761 - protein, 22 aa, Homo sapiens
KDLYANTVLSGGTTMYPGIADR

SEQ ID NO: 14762 - protein, 22 aa, Homo sapiens
KDLYANTVLSGGTTMYPGIADR

SEQ ID NO: 14763 - protein, 22 aa, Homo sapiens
KDLYANTVLSGGTTMYPGIADR

SEQ ID NO: 14764 - protein, 22 aa, Homo sapiens
KDLYANTVLSGGTTMYPGIADR

SEQ ID NO: 14765 - protein, 22 aa, Homo sapiens
KDLYANTVLSGGTTMYPGIADR

SEQ ID NO: 14766 - protein, 22 aa, Homo sapiens
KDLYANTVLSGGTTMYPGIADR

SEQ ID NO: 14767 - protein, 22 aa, Homo sapiens
KDLYANTVLSGGTTMYPGIADR

SEQ ID NO: 14768 - protein, 22 aa, Homo sapiens
KDLYANTVLSGGTTMYPGIADR

SEQ ID NO: 14769 - protein, 22 aa, Homo sapiens
KDLYANTVLSGGTTMYPGIADR

SEQ ID NO: 14770 - protein, 22 aa, Homo sapiens
KDLYANTVLSGGTTMYPGIADR

SEQ ID NO: 14771 - protein, 22 aa, Homo sapiens
KDLYANTVLSGGTTMYPGIADR

SEQ ID NO: 14772 - protein, 22 aa, Homo sapiens
KDLYANTVLSGGTTMYPGIADR

SEQ ID NO: 14773 - protein, 22 aa, Homo sapiens
KDLYANTVLSGGTTMYPGIADR

SEQ ID NO: 14774 - protein, 22 aa, Homo sapiens
KDLYANTVLSGGTTMYPGIADR

SEQ ID NO: 14775 - protein, 22 aa, Homo sapiens
KDLYANTVLSGGTTMYPGIADR

SEQ ID NO: 14776 - protein, 22 aa, Homo sapiens
KDLYANTVLSGGTTMYPGIADR

SEQ ID NO: 14777 - protein, 22 aa, Homo sapiens
KDLYANTVLSGGTTMYPGIADR

SEQ ID NO: 14778 - protein, 22 aa, Homo sapiens
KDLYANTVLSGGTTMYPGIADR

SEQ ID NO: 14779 - protein, 13 aa, Homo sapiens
EITALAPSTMKIK

SEQ ID NO: 14780 - protein, 22 aa, Homo sapiens
KDLYANTVLSGGTTMYPGIADR

SEQ ID NO: 14781 - protein, 22 aa, Homo sapiens
KDLYANTVLSGGTTMYPGIADR

SEQ ID NO: 14782 - protein, 22 aa, Homo sapiens
KDLYANTVLSGGTTMYPGIADR

SEQ ID NO: 14783 - protein, 22 aa, Homo sapiens
KDLYANTVLSGGTTMYPGIADR

SEQ ID NO: 14784 - protein, 22 aa, Homo sapiens
KDLYANTVLSGGTTMYPGIADR

SEQ ID NO: 14785 - protein, 22 aa, Homo sapiens
KDLYANTVLSGGTTMYPGIADR

SEQ ID NO: 14786 - protein, 22 aa, Homo sapiens
KDLYANTVLSGGTTMYPGIADR

SEQ ID NO: 14787 - protein, 22 aa, Homo sapiens
KDLYANTVLSGGTTMYPGIADR

SEQ ID NO: 14788 - protein, 13 aa, Homo sapiens
EITALAPSTMKIK

SEQ ID NO: 14789 - protein, 22 aa, Homo sapiens
KDLYANTVLSGGTTMYPGIADR

SEQ ID NO: 14790 - protein, 22 aa, Homo sapiens
KDLYANTVLSGGTTMYPGIADR

SEQ ID NO: 14791 - protein, 13 aa, Homo sapiens
EITALAPSTMKIK

SEQ ID NO: 14792 - protein, 22 aa, Homo sapiens
KDLYANTVLSGGTTMYPGIADR

SEQ ID NO: 14793 - protein, 13 aa, Homo sapiens
EITALAPSTMKIK

SEQ ID NO: 14794 - protein, 13 aa, Homo sapiens
EITALAPSTMKIK

SEQ ID NO: 14795 - protein, 22 aa, Homo sapiens
KDLYANTVLSGGTTMYPGIADR

SEQ ID NO: 14796 - protein, 22 aa, Homo sapiens
KDLYANTVLSGGTTMYPGIADR

SEQ ID NO: 14797 - protein, 22 aa, Homo sapiens
KDLYANTVLSGGTTMYPGIADR

SEQ ID NO: 14798 - protein, 22 aa, Homo sapiens
KDLYANTVLSGGTTMYPGIADR

SEQ ID NO: 14799 - protein, 22 aa, Homo sapiens
KDLYANTVLSGGTTMYPGIADR

SEQ ID NO: 14800 - protein, 13 aa, Homo sapiens
EITALAPSTMKIK

SEQ ID NO: 14801 - protein, 22 aa, Homo sapiens
KDLYANTVLSGGTTMYPGIADR

SEQ ID NO: 14802 - protein, 22 aa, Homo sapiens
KDLYANTVLSGGTTMYPGIADR

SEQ ID NO: 14803 - protein, 13 aa, Homo sapiens
EITALAPSTMKIK

SEQ ID NO: 14804 - protein, 13 aa, Homo sapiens
EITALAPSTMKIK

SEQ ID NO: 14805 - protein, 22 aa, Homo sapiens
KDLYANTVLSGGTTMYPGIADR

SEQ ID NO: 14806 - protein, 22 aa, Homo sapiens
KDLYANTVLSGGTTMYPGIADR

SEQ ID NO: 14807 - protein, 22 aa, Homo sapiens
KDLYANTVLSGGTTMYPGIADR

SEQ ID NO: 14808 - protein, 20 aa, Homo sapiens
EITALAPSTMKIKIIAPPER

SEQ ID NO: 14809 - protein, 22 aa, Homo sapiens
KDLYANTVLSGGTTMYPGIADR

SEQ ID NO: 14810 - protein, 22 aa, Homo sapiens
KDLYANTVLSGGTTMYPGIADR

SEQ ID NO: 14811 - protein, 22 aa, Homo sapiens
KDLYANTVLSGGTTMYPGIADR

SEQ ID NO: 14812 - protein, 22 aa, Homo sapiens
KDLYANTVLSGGTTMYPGIADR

SEQ ID NO: 14813 - protein, 22 aa, Homo sapiens
KDLYANTVLSGGTTMYPGIADR

SEQ ID NO: 14814 - protein, 22 aa, Homo sapiens
KDLYANTVLSGGTTMYPGIADR

SEQ ID NO: 14815 - protein, 22 aa, Homo sapiens
KDLYANTVLSGGTTMYPGIADR

SEQ ID NO: 14816 - protein, 20 aa, Homo sapiens
EITALAPSTMKIKIIAPPER

SEQ ID NO: 14817 - protein, 13 aa, Homo sapiens
EITALAPSTMKIK

SEQ ID NO: 14818 - protein, 22 aa, Homo sapiens
KDLYANTVLSGGTTMYPGIADR

SEQ ID NO: 14819 - protein, 22 aa, Homo sapiens
KDLYANTVLSGGTTMYPGIADR

SEQ ID NO: 14820 - protein, 22 aa, Homo sapiens
KDLYANTVLSGGTTMYPGIADR

SEQ ID NO: 14821 - protein, 22 aa, Homo sapiens
KDLYANTVLSGGTTMYPGIADR

SEQ ID NO: 14822 - protein, 22 aa, Homo sapiens
KDLYANTVLSGGTTMYPGIADR

SEQ ID NO: 14823 - protein, 22 aa, Homo sapiens
KDLYANTVLSGGTTMYPGIADR

SEQ ID NO: 14824 - protein, 22 aa, Homo sapiens
KDLYANTVLSGGTTMYPGIADR

SEQ ID NO: 14825 - protein, 22 aa, Homo sapiens
KDLYANTVLSGGTTMYPGIADR

SEQ ID NO: 14826 - protein, 22 aa, Homo sapiens
GILTLKYPIEHGIVTNWDDMEK

SEQ ID NO: 14827 - protein, 23 aa, Homo sapiens
HQGVMVGMGQKDSYVGDEAQSKR

SEQ ID NO: 14828 - protein, 23 aa, Homo sapiens
HQGVMVGMGQKDSYVGDEAQSKR

SEQ ID NO: 14829 - protein, 23 aa, Homo sapiens
HQGVMVGMGQKDSYVGDEAQSKR

SEQ ID NO: 14830 - protein, 33 aa, Homo sapiens; identical to SEQ ID NO: 2116

SEQ ID NO: 14831 - protein, 33 aa, Homo sapiens; identical to SEQ ID NO: 2116

SEQ ID NO: 14832 - protein, 33 aa, Homo sapiens; identical to SEQ ID NO: 2116

SEQ ID NO: 14833 - protein, 33 aa, Homo sapiens; identical to SEQ ID NO: 2116

SEQ ID NO: 14834 - protein, 33 aa, Homo sapiens; identical to SEQ ID NO: 2116

SEQ ID NO: 14835 - protein, 33 aa, Homo sapiens; identical to SEQ ID NO: 2116

SEQ ID NO: 14836 - protein, 33 aa, Homo sapiens; identical to SEQ ID NO: 2116

SEQ ID NO: 14837 - protein, 33 aa, Homo sapiens; identical to SEQ ID NO: 2116

SEQ ID NO: 14838 - protein, 33 aa, Homo sapiens; identical to SEQ ID NO: 2116

SEQ ID NO: 14839 - protein, 23 aa, Homo sapiens
HQGVMVGMGQKDSYVGDEAQSKR

SEQ ID NO: 14840 - protein, 33 aa, Homo sapiens; identical to SEQ ID NO: 2116

SEQ ID NO: 14841 - protein, 33 aa, Homo sapiens; identical to SEQ ID NO: 2116

SEQ ID NO: 14842 - protein, 23 aa, Homo sapiens
HQGVMVGMGQKDSYVGDEAQSKR

SEQ ID NO: 14843 - protein, 33 aa, Homo sapiens; identical to SEQ ID NO: 2116

SEQ ID NO: 14844 - protein, 33 aa, Homo sapiens; identical to SEQ ID NO: 2116

SEQ ID NO: 14845 - protein, 33 aa, Homo sapiens; identical to SEQ ID NO: 2116

SEQ ID NO: 14846 - protein, 33 aa, Homo sapiens; identical to SEQ ID NO: 2116

SEQ ID NO: 14847 - protein, 33 aa, Homo sapiens; identical to SEQ ID NO: 2116

SEQ ID NO: 14848 - protein, 23 aa, Homo sapiens
HQGVMVGMGQKDSYVGDEAQSKR

SEQ ID NO: 14849 - protein, 33 aa, Homo sapiens; identical to SEQ ID NO: 2116

SEQ ID NO: 14850 - protein, 23 aa, Homo sapiens
HQGVMVGMGQKDSYVGDEAQSKR

SEQ ID NO: 14851 - protein, 23 aa, Homo sapiens
HQGVMVGMGQKDSYVGDEAQSKR

SEQ ID NO: 14852 - protein, 22 aa, Homo sapiens
GILTLKYPIEHGIVTNWDDMEK

SEQ ID NO: 14853 - protein, 22 aa, Homo sapiens
GILTLKYPIEHGIVTNWDDMEK

SEQ ID NO: 14854 - protein, 23 aa, Homo sapiens
HQGVMVGMGQKDSYVGDEAQSKR

SEQ ID NO: 14855 - protein, 23 aa, Homo sapiens
HQGVMVGMGQKDSYVGDEAQSKR

SEQ ID NO: 14856 - protein, 33 aa, Homo sapiens; identical to SEQ ID NO: 2116

SEQ ID NO: 14857 - protein, 33 aa, Homo sapiens; identical to SEQ ID NO: 2116

SEQ ID NO: 14858 - protein, 23 aa, Homo sapiens
HQGVMVGMGQKDSYVGDEAQSKR

SEQ ID NO: 14859 - protein, 33 aa, Homo sapiens; identical to SEQ ID NO: 2116

SEQ ID NO: 14860 - protein, 22 aa, Homo sapiens
GILTLKYPIEHGIVTNWDDMEK

SEQ ID NO: 14861 - protein, 23 aa, Homo sapiens
HQGVMVGMGQKDSYVGDEAQSKR

SEQ ID NO: 14862 - protein, 33 aa, Homo sapiens; identical to SEQ ID NO: 2116

SEQ ID NO: 14863 - protein, 33 aa, Homo sapiens; identical to SEQ ID NO: 2116

SEQ ID NO: 14864 - protein, 23 aa, Homo sapiens
HQGVMVGMGQKDSYVGDEAQSKR

SEQ ID NO: 14865 - protein, 33 aa, Homo sapiens; identical to SEQ ID NO: 2116

SEQ ID NO: 14866 - protein, 23 aa, Homo sapiens
HQGVMVGMGQKDSYVGDEAQSKR

SEQ ID NO: 14867 - protein, 23 aa, Homo sapiens
HQGVMVGMGQKDSYVGDEAQSKR

SEQ ID NO: 14868 - protein, 23 aa, Homo sapiens
HQGVMVGMGQKDSYVGDEAQSKR

SEQ ID NO: 14869 - protein, 22 aa, Homo sapiens
GILTLKYPIEHGIVTNWDDMEK

SEQ ID NO: 14870 - protein, 33 aa, Homo sapiens; identical to SEQ ID NO: 2116

SEQ ID NO: 14871 - protein, 23 aa, Homo sapiens
HQGVMVGMGQKDSYVGDEAQSKR

SEQ ID NO: 14872 - protein, 23 aa, Homo sapiens
HQGVMVGMGQKDSYVGDEAQSKR

SEQ ID NO: 14873 - protein, 33 aa, Homo sapiens; identical to SEQ ID NO: 2116

SEQ ID NO: 14874 - protein, 23 aa, Homo sapiens
HQGVMVGMGQKDSYVGDEAQSKR

SEQ ID NO: 14875 - protein, 23 aa, Homo sapiens
HQGVMVGMGQKDSYVGDEAQSKR

SEQ ID NO: 14876 - protein, 23 aa, Homo sapiens
HQGVMVGMGQKDSYVGDEAQSKR

SEQ ID NO: 14877 - protein, 23 aa, Homo sapiens
HQGVMVGMGQKDSYVGDEAQSKR

SEQ ID NO: 14878 - protein, 33 aa, Homo sapiens; identical to SEQ ID NO: 2116

SEQ ID NO: 14879 - protein, 22 aa, Homo sapiens
GILTLKYPIEHGIVTNWDDMEK

SEQ ID NO: 14880 - protein, 23 aa, Homo sapiens
HQGVMVGMGQKDSYVGDEAQSKR

SEQ ID NO: 14881 - protein, 23 aa, Homo sapiens
HQGVMVGMGQKDSYVGDEAQSKR

SEQ ID NO: 14882 - protein, 23 aa, Homo sapiens
HQGVMVGMGQKDSYVGDEAQSKR

SEQ ID NO: 14883 - protein, 23 aa, Homo sapiens
HQGVMVGMGQKDSYVGDEAQSKR

SEQ ID NO: 14884 - protein, 23 aa, Homo sapiens
HQGVMVGMGQKDSYVGDEAQSKR

SEQ ID NO: 14885 - protein, 23 aa, Homo sapiens
HQGVMVGMGQKDSYVGDEAQSKR

SEQ ID NO: 14886 - protein, 22 aa, Homo sapiens
GILTLKYPIEHGIVTNWDDMEK

SEQ ID NO: 14887 - protein, 23 aa, Homo sapiens
HQGVMVGMGQKDSYVGDEAQSKR

SEQ ID NO: 14888 - protein, 23 aa, Homo sapiens
HQGVMVGMGQKDSYVGDEAQSKR

SEQ ID NO: 14889 - protein, 23 aa, Homo sapiens
HQGVMVGMGQKDSYVGDEAQSKR

SEQ ID NO: 14890 - protein, 23 aa, Homo sapiens
HQGVMVGMGQKDSYVGDEAQSKR

SEQ ID NO: 14891 - protein, 23 aa, Homo sapiens
HQGVMVGMGQKDSYVGDEAQSKR

SEQ ID NO: 14892 - protein, 22 aa, Homo sapiens
GILTLKYPIEHGIVTNWDDMEK

SEQ ID NO: 14893 - protein, 23 aa, Homo sapiens
HQGVMVGMGQKDSYVGDEAQSKR

SEQ ID NO: 14894 - protein, 23 aa, Homo sapiens
HQGVMVGMGQKDSYVGDEAQSKR

SEQ ID NO: 14895 - protein, 11 aa, Homo sapiens
PPDKPLMPYMR

SEQ ID NO: 14896 - protein, 11 aa, Homo sapiens
PPDKPLMPYMR

SEQ ID NO: 14897 - protein, 11 aa, Homo sapiens
PPDKPLMPYMR

SEQ ID NO: 14898 - protein, 11 aa, Homo sapiens
PPDKPLMPYMR

SEQ ID NO: 14899 - protein, 14 aa, Homo sapiens
VTASSGITIPKPPK

SEQ ID NO: 14900 - protein, 11 aa, Homo sapiens
PPDKPLMPYMR

SEQ ID NO: 14901 - protein, 14 aa, Homo sapiens
VTASSGITIPKPPK

SEQ ID NO: 14902 - protein, 6 aa, Homo sapiens
HQEKKR

SEQ ID NO: 14903 - protein, 12 aa, Homo sapiens
KLEAELLQIEER

SEQ ID NO: 14904 - protein, 5 aa, Homo sapiens
HQEKK

SEQ ID NO: 14905 - protein, 6 aa, Homo sapiens
HQEKKR

SEQ ID NO: 14906 - protein, 15 aa, Homo sapiens
KFLESTDSFNNELKR

SEQ ID NO: 14907 - protein, 6 aa, Homo sapiens
MQVLKR

SEQ ID NO: 14908 - protein, 6 aa, Homo sapiens
MQVLKR

SEQ ID NO: 14909 - protein, 6 aa, Homo sapiens
HQEKKR

SEQ ID NO: 14910 - protein, 12 aa, Homo sapiens
LCGLKVEVDMEK

SEQ ID NO: 14911 - protein, 6 aa, Homo sapiens
KRQEER

SEQ ID NO: 14912 - protein, 6 aa, Homo sapiens
MQVLKR

SEQ ID NO: 14913 - protein, 6 aa, Homo sapiens
MQVLKR

SEQ ID NO: 14914 - protein, 6 aa, Homo sapiens
MQVLKR

SEQ ID NO: 14915 - protein, 6 aa, Homo sapiens
MQVLKR

SEQ ID NO: 14916 - protein, 12 aa, Homo sapiens
KLEAELLQIEER

SEQ ID NO: 14917 - protein, 6 aa, Homo sapiens
HQEKKR

SEQ ID NO: 14918 - protein, 11 aa, Homo sapiens
PPDKPLMPYMR

SEQ ID NO: 14919 - protein, 32 aa, Homo sapiens
MEKGEPYMSIQPAEDPDDYDDGFSMKHTATAR

SEQ ID NO: 14920 - protein, 6 aa, Homo sapiens
KRQEER

SEQ ID NO: 14921 - protein, 6 aa, Homo sapiens
MQVLKR

SEQ ID NO: 14922 - protein, 6 aa, Homo sapiens
MQVLKR

SEQ ID NO: 14923 - protein, 18 aa, Homo sapiens
DLTDEEKQEYLNEYEAEK

SEQ ID NO: 14924 - protein, 18 aa, Homo sapiens
DLTDEEKQEYLNEYEAEK

SEQ ID NO: 14925 - protein, 15 aa, Homo sapiens
KFLESTDSFNNELKR

SEQ ID NO: 14926 - protein, 12 aa, Homo sapiens
LCGLKVEVDMEK

SEQ ID NO: 14927 - protein, 14 aa, Homo sapiens
FLESTDSFNNELKR

SEQ ID NO: 14928 - protein, 14 aa, Homo sapiens
FLESTDSFNNELKR

SEQ ID NO: 14929 - protein, 15 aa, Homo sapiens
KFLESTDSFNNELKR

SEQ ID NO: 14930 - protein, 14 aa, Homo sapiens
FLESTDSFNNELKR

SEQ ID NO: 14931 - protein, 14 aa, Homo sapiens
FLESTDSFNNELKR

SEQ ID NO: 14932 - protein, 12 aa, Homo sapiens
LCGLKVEVDMEK

SEQ ID NO: 14933 - protein, 14 aa, Homo sapiens
FLESTDSFNNELKR

SEQ ID NO: 14934 - protein, 14 aa, Homo sapiens
FLESTDSFNNELKR

SEQ ID NO: 14935 - protein, 14 aa, Homo sapiens
FLESTDSFNNELKR

SEQ ID NO: 14936 - protein, 14 aa, Homo sapiens
FLESTDSFNNELKR

SEQ ID NO: 14937 - protein, 15 aa, Homo sapiens
KFLESTDSFNNELKR

SEQ ID NO: 14938 - protein, 15 aa, Homo sapiens
KFLESTDSFNNELKR

SEQ ID NO: 14939 - protein, 12 aa, Homo sapiens
LCGLKVEVDMEK

SEQ ID NO: 14940 - protein, 12 aa, Homo sapiens
LCGLKVEVDMEK

SEQ ID NO: 14941 - protein, 14 aa, Homo sapiens
FLESTDSFNNELKR

SEQ ID NO: 14942 - protein, 15 aa, Homo sapiens
KFLESTDSFNNELKR

SEQ ID NO: 14943 - protein, 14 aa, Homo sapiens
FLESTDSFNNELKR

SEQ ID NO: 14944 - protein, 25 aa, Homo sapiens
LCGLKVEVDMEKIAAEIAQAEEQAR

SEQ ID NO: 14945 - protein, 12 aa, Homo sapiens
LCGLKVEVDMEK

SEQ ID NO: 14946 - protein, 12 aa, Homo sapiens
LCGLKVEVDMEK

SEQ ID NO: 14947 - protein, 12 aa, Homo sapiens
LCGLKVEVDMEK

SEQ ID NO: 14948 - protein, 15 aa, Homo sapiens
KFLESTDSFNNELKR

SEQ ID NO: 14949 - protein, 14 aa, Homo sapiens
FLESTDSFNNELKR

SEQ ID NO: 14950 - protein, 12 aa, Homo sapiens
LCGLKVEVDMEK

SEQ ID NO: 14951 - protein, 25 aa, Homo sapiens
LCGLKVEVDMEKIAAEIAQAEEQAR

SEQ ID NO: 14952 - protein, 15 aa, Homo sapiens
KFLESTDSFNNELKR

SEQ ID NO: 14953 - protein, 14 aa, Homo sapiens
FLESTDSFNNELKR

SEQ ID NO: 14954 - protein, 15 aa, Homo sapiens
KFLESTDSFNNELKR

SEQ ID NO: 14955 - protein, 12 aa, Homo sapiens
LCGLKVEVDMEK

SEQ ID NO: 14956 - protein, 15 aa, Homo sapiens
KFLESTDSFNNELKR

SEQ ID NO: 14957 - protein, 14 aa, Homo sapiens
FLESTDSFNNELKR

SEQ ID NO: 14958 - protein, 15 aa, Homo sapiens
KFLESTDSFNNELKR

SEQ ID NO: 14959 - protein, 12 aa, Homo sapiens
LCGLKVEVDMEK

SEQ ID NO: 14960 - protein, 12 aa, Homo sapiens
LCGLKVEVDMEK

SEQ ID NO: 14961 - protein, 15 aa, Homo sapiens
KFLESTDSFNNELKR

SEQ ID NO: 14962 - protein, 15 aa, Homo sapiens
KFLESTDSFNNELKR

SEQ ID NO: 14963 - protein, 15 aa, Homo sapiens
KFLESTDSFNNELKR

SEQ ID NO: 14964 - protein, 12 aa, Homo sapiens
LCGLKVEVDMEK

SEQ ID NO: 14965 - protein, 12 aa, Homo sapiens
LCGLKVEVDMEK

SEQ ID NO: 14966 - protein, 14 aa, Homo sapiens
FLESTDSFNNELKR

SEQ ID NO: 14967 - protein, 15 aa, Homo sapiens
KFLESTDSFNNELKR

SEQ ID NO: 14968 - protein, 14 aa, Homo sapiens
FLESTDSFNNELKR

SEQ ID NO: 14969 - protein, 15 aa, Homo sapiens
KFLESTDSFNNELKR

SEQ ID NO: 14970 - protein, 15 aa, Homo sapiens
KFLESTDSFNNELKR

SEQ ID NO: 14971 - protein, 12 aa, Homo sapiens
LCGLKVEVDMEK

SEQ ID NO: 14972 - protein, 15 aa, Homo sapiens
KFLESTDSFNNELKR

SEQ ID NO: 14973 - protein, 12 aa, Homo sapiens
LCGLKVEVDMEK

SEQ ID NO: 14974 - protein, 15 aa, Homo sapiens
KFLESTDSFNNELKR

SEQ ID NO: 14975 - protein, 15 aa, Homo sapiens
KFLESTDSFNNELKR

SEQ ID NO: 14976 - protein, 14 aa, Homo sapiens
FLESTDSFNNELKR

SEQ ID NO: 14977 - protein, 14 aa, Homo sapiens
FLESTDSFNNELKR

SEQ ID NO: 14978 - protein, 14 aa, Homo sapiens
FLESTDSFNNELKR

SEQ ID NO: 14979 - protein, 14 aa, Homo sapiens
FLESTDSFNNELKR

SEQ ID NO: 14980 - protein, 14 aa, Homo sapiens
FLESTDSFNNELKR

SEQ ID NO: 14981 - protein, 12 aa, Homo sapiens
LCGLKVEVDMEK

SEQ ID NO: 14982 - protein, 6 aa, Homo sapiens
KRQEER

SEQ ID NO: 14983 - protein, 19 aa, Homo sapiens
FLESTDSFNNELKRLCGLK

SEQ ID NO: 14984 - protein, 19 aa, Homo sapiens
FLESTDSFNNELKRLCGLK

SEQ ID NO: 14985 - protein, 19 aa, Homo sapiens
FLESTDSFNNELKRLCGLK

SEQ ID NO: 14986 - protein, 25 aa, Homo sapiens
LCGLKVEVDMEKIAAEIAQAEEQAR

SEQ ID NO: 14987 - protein, 25 aa, Homo sapiens
LCGLKVEVDMEKIAAEIAQAEEQAR

SEQ ID NO: 14988 - protein, 32 aa, Homo sapiens; identical to SEQ ID NO: 14919

SEQ ID NO: 14989 - protein, 6 aa, Homo sapiens
KRQEER

SEQ ID NO: 14990 - protein, 6 aa, Homo sapiens
KRQEER

SEQ ID NO: 14991 - protein, 6 aa, Homo sapiens
KRQEER

SEQ ID NO: 14992 - protein, 5 aa, Homo sapiens
HQEKK

SEQ ID NO: 14993 - protein, 15 aa, Homo sapiens
KFLESTDSFNNELKR

SEQ ID NO: 14994 - protein, 15 aa, Homo sapiens
KFLESTDSFNNELKR

SEQ ID NO: 14995 - protein, 6 aa, Homo sapiens
HQEKKR

SEQ ID NO: 14996 - protein, 6 aa, Homo sapiens
HQEKKR

SEQ ID NO: 14997 - protein, 15 aa, Homo sapiens
KFLESTDSFNNELKR

SEQ ID NO: 14998 - protein, 15 aa, Homo sapiens
KFLESTDSFNNELKR

SEQ ID NO: 14999 - protein, 15 aa, Homo sapiens
KFLESTDSFNNELKR

SEQ ID NO: 15000 - protein, 15 aa, Homo sapiens
KFLESTDSFNNELKR

SEQ ID NO: 15001 - protein, 6 aa, Homo sapiens
HQEKKR

SEQ ID NO: 15002 - protein, 6 aa, Homo sapiens
HQEKKR

SEQ ID NO: 15003 - protein, 15 aa, Homo sapiens
KFLESTDSFNNELKR

SEQ ID NO: 15004 - protein, 6 aa, Homo sapiens
HQEKKR

SEQ ID NO: 15005 - protein, 5 aa, Homo sapiens
HQEKK

SEQ ID NO: 15006 - protein, 6 aa, Homo sapiens
HQEKKR

SEQ ID NO: 15007 - protein, 15 aa, Homo sapiens
KFLESTDSFNNELKR

SEQ ID NO: 15008 - protein, 6 aa, Homo sapiens
HQEKKR

SEQ ID NO: 15009 - protein, 6 aa, Homo sapiens
HQEKKR

SEQ ID NO: 15010 - protein, 5 aa, Homo sapiens
HQEKK

SEQ ID NO: 15011 - protein, 6 aa, Homo sapiens
HQEKKR

SEQ ID NO: 15012 - protein, 6 aa, Homo sapiens
HQEKKR

SEQ ID NO: 15013 - protein, 6 aa, Homo sapiens
HQEKKR

SEQ ID NO: 15014 - protein, 15 aa, Homo sapiens
KFLESTDSFNNELKR

SEQ ID NO: 15015 - protein, 25 aa, Homo sapiens
LCGLKVEVDMEKIAAEIAQAEEQAR

SEQ ID NO: 15016 - protein, 25 aa, Homo sapiens
LCGLKVEVDMEKIAAEIAQAEEQAR

SEQ ID NO: 15017 - protein, 14 aa, Homo sapiens
FLESTDSFNNELKR

SEQ ID NO: 15018 - protein, 25 aa, Homo sapiens
LCGLKVEVDMEKIAAEIAQAEEQAR

SEQ ID NO: 15019 - protein, 25 aa, Homo sapiens
LCGLKVEVDMEKIAAEIAQAEEQAR

SEQ ID NO: 15020 - protein, 5 aa, Homo sapiens
KIKER

SEQ ID NO: 15021 - protein, 5 aa, Homo sapiens
KIKER

SEQ ID NO: 15022 - protein, 16 aa, Homo sapiens
ELPEYYELIRKPVDFK

SEQ ID NO: 15023 - protein, 7 aa, Homo sapiens
KPVDFKK

SEQ ID NO: 15024 - protein, 7 aa, Homo sapiens
KPVDFKK

SEQ ID NO: 15025 - protein, 6 aa, Homo sapiens
KPVDFK

SEQ ID NO: 15026 - protein, 7 aa, Homo sapiens
KPVDFKK

SEQ ID NO: 15027 - protein, 6 aa, Homo sapiens
KPVDFK

SEQ ID NO: 15028 - protein, 7 aa, Homo sapiens
KPVDFKK

SEQ ID NO: 15029 - protein, 6 aa, Homo sapiens
KPVDFK

SEQ ID NO: 15030 - protein, 6 aa, Homo sapiens
KPVDFK

SEQ ID NO: 15031 - protein, 7 aa, Homo sapiens
IRNHKYR

SEQ ID NO: 15032 - protein, 6 aa, Homo sapiens
KPVDFK

SEQ ID NO: 15033 - protein, 7 aa, Homo sapiens
KPVDFKK

SEQ ID NO: 15034 - protein, 6 aa, Homo sapiens
KPVDFK

SEQ ID NO: 15035 - protein, 7 aa, Homo sapiens
IRNHKYR

SEQ ID NO: 15036 - protein, 7 aa, Homo sapiens
KLIDQKK

SEQ ID NO: 15037 - protein, 7 aa, Homo sapiens
KLIDQKK

SEQ ID NO: 15038 - protein, 7 aa, Homo sapiens
KLIDQKK

SEQ ID NO: 15039 - protein, 7 aa, Homo sapiens
KLIDQKK

SEQ ID NO: 15040 - protein, 5 aa, Homo sapiens
IEKER

SEQ ID NO: 15041 - protein, 11 aa, Homo sapiens
LHKVLRPFLLR

SEQ ID NO: 15042 - protein, 4 aa, Homo sapiens
RKPR

SEQ ID NO: 15043 - protein, 4 aa, Homo sapiens
RKPR

SEQ ID NO: 15044 - protein, 4 aa, Homo sapiens
RKPR

SEQ ID NO: 15045 - protein, 15 aa, Homo sapiens
DVDYSDALTEKQWLR

SEQ ID NO: 15046 - protein, 15 aa, Homo sapiens
DVDYSDALTEKQWLR

SEQ ID NO: 15047 - protein, 20 aa, Homo sapiens
LMEEDELPSWIIKDDAEVER

SEQ ID NO: 15048 - protein, 11 aa, Homo sapiens
KELPEYYELIR

SEQ ID NO: 15049 - protein, 20 aa, Homo sapiens
LMEEDELPSWIIKDDAEVER

SEQ ID NO: 15050 - protein, 20 aa, Homo sapiens
LMEEDELPSWIIKDDAEVER

SEQ ID NO: 15051 - protein, 20 aa, Homo sapiens
LMEEDELPSWIIKDDAEVER

SEQ ID NO: 15052 - protein, 20 aa, Homo sapiens
LMEEDELPSWIIKDDAEVER

SEQ ID NO: 15053 - protein, 20 aa, Homo sapiens
LMEEDELPSWIIKDDAEVER

SEQ ID NO: 15054 - protein, 20 aa, Homo sapiens
LMEEDELPSWIIKDDAEVER

SEQ ID NO: 15055 - protein, 20 aa, Homo sapiens
LMEEDELPSWIIKDDAEVER

SEQ ID NO: 15056 - protein, 20 aa, Homo sapiens
LMEEDELPSWIIKDDAEVER

SEQ ID NO: 15057 - protein, 20 aa, Homo sapiens
LMEEDELPSWIIKDDAEVER

SEQ ID NO: 15058 - protein, 20 aa, Homo sapiens
LMEEDELPSWIIKDDAEVER

SEQ ID NO: 15059 - protein, 20 aa, Homo sapiens
LMEEDELPSWIIKDDAEVER

SEQ ID NO: 15060 - protein, 20 aa, Homo sapiens
LMEEDELPSWIIKDDAEVER

SEQ ID NO: 15061 - protein, 20 aa, Homo sapiens
LMEEDELPSWIIKDDAEVER

SEQ ID NO: 15062 - protein, 11 aa, Homo sapiens
KELPEYYELIR

SEQ ID NO: 15063 - protein, 17 aa, Homo sapiens
VIQAGMFDQKSSSHERR

SEQ ID NO: 15064 - protein, 7 aa, Homo sapiens
DFKEYHR

SEQ ID NO: 15065 - protein, 7 aa, Homo sapiens
DFKEYHR

SEQ ID NO: 15066 - protein, 15 aa, Homo sapiens
AVATWHANTEREQKK

SEQ ID NO: 15067 - protein, 8 aa, Homo sapiens
EQKKETER

SEQ ID NO: 15068 - protein, 8 aa, Homo sapiens
LIDQKKDR

SEQ ID NO: 15069 - protein, 9 aa, Homo sapiens
ETERIEKER

SEQ ID NO: 15070 - protein, 9 aa, Homo sapiens
ETERIEKER

SEQ ID NO: 15071 - protein, 9 aa, Homo sapiens
ETERIEKER

SEQ ID NO: 15072 - protein, 14 aa, Homo sapiens
GGAKTLMNTIMQLR

SEQ ID NO: 15073 - protein, 6 aa, Homo sapiens
AALLKK

SEQ ID NO: 15074 - protein, 6 aa, Homo sapiens
AALLKK

SEQ ID NO: 15075 - protein, 7 aa, Homo sapiens
DKHILAK

SEQ ID NO: 15076 - protein, 7 aa, Homo sapiens
DKHILAK

SEQ ID NO: 15077 - protein, 7 aa, Homo sapiens
DKHILAK

SEQ ID NO: 15078 - protein, 7 aa, Homo sapiens
DKHILAK

SEQ ID NO: 15079 - protein, 7 aa, Homo sapiens
DKHILAK

SEQ ID NO: 15080 - protein, 7 aa, Homo sapiens
DKHILAK

SEQ ID NO: 15081 - protein, 18 aa, Homo sapiens
NHHCKLTQVLNTHYVAPR

SEQ ID NO: 15082 - protein, 7 aa, Homo sapiens
DKHILAK

SEQ ID NO: 15083 - protein, 20 aa, Homo sapiens
MKNHHCKLTQVLNTHYVAPR

SEQ ID NO: 15084 - protein, 7 aa, Homo sapiens
DKHILAK

SEQ ID NO: 15085 - protein, 18 aa, Homo sapiens
NHHCKLTQVLNTHYVAPR

SEQ ID NO: 15086 - protein, 18 aa, Homo sapiens
NHHCKLTQVLNTHYVAPR

SEQ ID NO: 15087 - protein, 7 aa, Homo sapiens
DKHILAK

SEQ ID NO: 15088 - protein, 20 aa, Homo sapiens
MKNHHCKLTQVLNTHYVAPR

SEQ ID NO: 15089 - protein, 20 aa, Homo sapiens
MKNHHCKLTQVLNTHYVAPR

SEQ ID NO: 15090 - protein, 18 aa, Homo sapiens
NHHCKLTQVLNTHYVAPR

SEQ ID NO: 15091 - protein, 20 aa, Homo sapiens
MKNHHCKLTQVLNTHYVAPR

SEQ ID NO: 15092 - protein, 20 aa, Homo sapiens
MKNHHCKLTQVLNTHYVAPR

SEQ ID NO: 15093 - protein, 20 aa, Homo sapiens
MKNHHCKLTQVLNTHYVAPR

SEQ ID NO: 15094 - protein, 20 aa, Homo sapiens
MKNHHCKLTQVLNTHYVAPR

SEQ ID NO: 15095 - protein, 20 aa, Homo sapiens
MKNHHCKLTQVLNTHYVAPR

SEQ ID NO: 15096 - protein, 20 aa, Homo sapiens
MKNHHCKLTQVLNTHYVAPR

SEQ ID NO: 15097 - protein, 20 aa, Homo sapiens
MKNHHCKLTQVLNTHYVAPR

SEQ ID NO: 15098 - protein, 20 aa, Homo sapiens
MKNHHCKLTQVLNTHYVAPR

SEQ ID NO: 15099 - protein, 20 aa, Homo sapiens
MKNHHCKLTQVLNTHYVAPR

SEQ ID NO: 15100 - protein, 20 aa, Homo sapiens
MKNHHCKLTQVLNTHYVAPR

SEQ ID NO: 15101 - protein, 20 aa, Homo sapiens
MKNHHCKLTQVLNTHYVAPR

SEQ ID NO: 15102 - protein, 7 aa, Homo sapiens
DKHILAK

SEQ ID NO: 15103 - protein, 18 aa, Homo sapiens
NHHCKLTQVLNTHYVAPR

SEQ ID NO: 15104 - protein, 20 aa, Homo sapiens
MKNHHCKLTQVLNTHYVAPR

SEQ ID NO: 15105 - protein, 20 aa, Homo sapiens
MKNHHCKLTQVLNTHYVAPR

SEQ ID NO: 15106 - protein, 20 aa, Homo sapiens
MKNHHCKLTQVLNTHYVAPR

SEQ ID NO: 15107 - protein, 14 aa, Homo sapiens
LSKAVATWHANTER

SEQ ID NO: 15108 - protein, 8 aa, Homo sapiens
YKLNVDQK

SEQ ID NO: 15109 - protein, 8 aa, Homo sapiens
YKLNVDQK

SEQ ID NO: 15110 - protein, 16 aa, Homo sapiens
LCTVNSVEEKILAAAK

SEQ ID NO: 15111 - protein, 11 aa, Homo sapiens
WKYMIVDEGHR

SEQ ID NO: 15112 - protein, 11 aa, Homo sapiens
WKYMIVDEGHR

SEQ ID NO: 15113 - protein, 16 aa, Homo sapiens
SGKFNVLLTTYEYIIK

SEQ ID NO: 15114 - protein, 21 aa, Homo sapiens
QIIETAKQDVDDEYSMQYSAR

SEQ ID NO: 15115 - protein, 21 aa, Homo sapiens
QIIETAKQDVDDEYSMQYSAR

SEQ ID NO: 15116 - protein, 21 aa, Homo sapiens
QIIETAKQDVDDEYSMQYSAR

SEQ ID NO: 15117 - protein, 21 aa, Homo sapiens
QIIETAKQDVDDEYSMQYSAR

SEQ ID NO: 15118 - protein, 21 aa, Homo sapiens
QIIETAKQDVDDEYSMQYSAR

SEQ ID NO: 15119 - protein, 21 aa, Homo sapiens
QIIETAKQDVDDEYSMQYSAR

SEQ ID NO: 15120 - protein, 21 aa, Homo sapiens
QIIETAKQDVDDEYSMQYSAR

SEQ ID NO: 15121 - protein, 21 aa, Homo sapiens
QIIETAKQDVDDEYSMQYSAR

SEQ ID NO: 15122 - protein, 21 aa, Homo sapiens
QIIETAKQDVDDEYSMQYSAR

SEQ ID NO: 15123 - protein, 16 aa, Homo sapiens
ILLDPNSEEVSEKDAK

SEQ ID NO: 15124 - protein, 21 aa, Homo sapiens
QIIETAKQDVDDEYSMQYSAR

SEQ ID NO: 15125 - protein, 16 aa, Homo sapiens
ILLDPNSEEVSEKDAK

SEQ ID NO: 15126 - protein, 16 aa, Homo sapiens
ILLDPNSEEVSEKDAK

SEQ ID NO: 15127 - protein, 16 aa, Homo sapiens
ILLDPNSEEVSEKDAK

SEQ ID NO: 15128 - protein, 16 aa, Homo sapiens
ILLDPNSEEVSEKDAK

SEQ ID NO: 15129 - protein, 16 aa, Homo sapiens
ILLDPNSEEVSEKDAK

SEQ ID NO: 15130 - protein, 8 aa, Homo sapiens
EQKKETER

SEQ ID NO: 15131 - protein, 5 aa, Homo sapiens
KETER

SEQ ID NO: 15132 - protein, 8 aa, Homo sapiens
EQKKETER

SEQ ID NO: 15133 - protein, 11 aa, Homo sapiens
LHKVLRPFLLR

SEQ ID NO: 15134 - protein, 18 aa, Homo sapiens
NHHCKLTQVLNTHYVAPR

SEQ ID NO: 15135 - protein, 20 aa, Homo sapiens
MKNHHCKLTQVLNTHYVAPR

SEQ ID NO: 15136 - protein, 20 aa, Homo sapiens
MKNHHCKLTQVLNTHYVAPR

SEQ ID NO: 15137 - protein, 20 aa, Homo sapiens
MKNHHCKLTQVLNTHYVAPR

SEQ ID NO: 15138 - protein, 20 aa, Homo sapiens
MKNHHCKLTQVLNTHYVAPR

SEQ ID NO: 15139 - protein, 20 aa, Homo sapiens
MKNHHCKLTQVLNTHYVAPR

SEQ ID NO: 15140 - protein, 7 aa, Homo sapiens
KPVDFKK

SEQ ID NO: 15141 - protein, 7 aa, Homo sapiens
KPVDFKK

SEQ ID NO: 15142 - protein, 11 aa, Homo sapiens
WKYMIVDEGHR

SEQ ID NO: 15143 - protein, 11 aa, Homo sapiens
WKYMIVDEGHR

SEQ ID NO: 15144 - protein, 11 aa, Homo sapiens
WKYMIVDEGHR

SEQ ID NO: 15145 - protein, 7 aa, Homo sapiens
KPVDFKK

SEQ ID NO: 15146 - protein, 10 aa, Homo sapiens
ISYKGTPAMR

SEQ ID NO: 15147 - protein, 10 aa, Homo sapiens
LDGTTKSEDR

SEQ ID NO: 15148 - protein, 10 aa, Homo sapiens
LDGTTKSEDR

SEQ ID NO: 15149 - protein, 10 aa, Homo sapiens
LDGTTKSEDR

SEQ ID NO: 15150 - protein, 10 aa, Homo sapiens
ASGKFELLDR

SEQ ID NO: 15151 - protein, 4 aa, Homo sapiens
RKPR

SEQ ID NO: 15152 - protein, 8 aa, Homo sapiens
YKLNVDQK

SEQ ID NO: 15153 - protein, 8 aa, Homo sapiens
YKLNVDQK

SEQ ID NO: 15154 - protein, 16 aa, Homo sapiens
VIQAGMFDQKSSSHER

SEQ ID NO: 15155 - protein, 8 aa, Homo sapiens
YKLNVDQK

SEQ ID NO: 15156 - protein, 8 aa, Homo sapiens
YKLNVDQK

SEQ ID NO: 15157 - protein, 16 aa, Homo sapiens
VIQAGMFDQKSSSHER

SEQ ID NO: 15158 - protein, 8 aa, Homo sapiens
YKLNVDQK

SEQ ID NO: 15159 - protein, 8 aa, Homo sapiens
YKLNVDQK

SEQ ID NO: 15160 - protein, 16 aa, Homo sapiens
VIQAGMFDQKSSSHER

SEQ ID NO: 15161 - protein, 16 aa, Homo sapiens
VIQAGMFDQKSSSHER

SEQ ID NO: 15162 - protein, 8 aa, Homo sapiens
YKLNVDQK

SEQ ID NO: 15163 - protein, 16 aa, Homo sapiens
VIQAGMFDQKSSSHER

SEQ ID NO: 15164 - protein, 17 aa, Homo sapiens
VIQAGMFDQKSSSHERR

SEQ ID NO: 15165 - protein, 8 aa, Homo sapiens
YKLNVDQK

SEQ ID NO: 15166 - protein, 8 aa, Homo sapiens
YKLNVDQK

SEQ ID NO: 15167 - protein, 8 aa, Homo sapiens
YKLNVDQK

SEQ ID NO: 15168 - protein, 8 aa, Homo sapiens
YKLNVDQK

SEQ ID NO: 15169 - protein, 7 aa, Homo sapiens
IRNHKYR

SEQ ID NO: 15170 - protein, 7 aa, Homo sapiens
IRNHKYR

SEQ ID NO: 15171 - protein, 5 aa, Homo sapiens
KIKER

SEQ ID NO: 15172 - protein, 5 aa, Homo sapiens
KIKER

SEQ ID NO: 15173 - protein, 5 aa, Homo sapiens
KIKER

SEQ ID NO: 15174 - protein, 5 aa, Homo sapiens
KIKER

SEQ ID NO: 15175 - protein, 6 aa, Homo sapiens
KLIDQK

SEQ ID NO: 15176 - protein, 6 aa, Homo sapiens
KLIDQK

SEQ ID NO: 15177 - protein, 6 aa, Homo sapiens
LIDQKK

SEQ ID NO: 15178 - protein, 11 aa, Homo sapiens
LHKVLRPFLLR

SEQ ID NO: 15179 - protein, 6 aa, Homo sapiens
LIDQKK

SEQ ID NO: 15180 - protein, 11 aa, Homo sapiens
WKYMIVDEGHR

SEQ ID NO: 15181 - protein, 11 aa, Homo sapiens
WKYMIVDEGHR

SEQ ID NO: 15182 - protein, 11 aa, Homo sapiens
WKYMIVDEGHR

SEQ ID NO: 15183 - protein, 11 aa, Homo sapiens
WKYMIVDEGHR

SEQ ID NO: 15184 - protein, 16 aa, Homo sapiens
TIQTIALITYLMEHKR

SEQ ID NO: 15185 - protein, 16 aa, Homo sapiens
TIQTIALITYLMEHKR

SEQ ID NO: 15186 - protein, 16 aa, Homo sapiens
TIQTIALITYLMEHKR

SEQ ID NO: 15187 - protein, 16 aa, Homo sapiens
TIQTIALITYLMEHKR

SEQ ID NO: 15188 - protein, 16 aa, Homo sapiens
TIQTIALITYLMEHKR

SEQ ID NO: 15189 - protein, 16 aa, Homo sapiens
TIQTIALITYLMEHKR

SEQ ID NO: 15190 - protein, 32 aa, Homo sapiens
KAFASNLPTLNVAKAASSGPGKPSGLQYESKL

SEQ ID NO: 15191 - protein, 16 aa, Homo sapiens
RMQKEITALAPSTMKI

SEQ ID NO: 15192 - protein, 16 aa, Homo sapiens
RMQKEITALAPSTMKI

SEQ ID NO: 15193 - protein, 21 aa, Homo sapiens
RLDLAGRDLTDYLMKILTERG

SEQ ID NO: 15194 - protein, 10 aa, Homo sapiens
REQKKENERI

SEQ ID NO: 15195 - protein, 10 aa, Homo sapiens
REQKKENERI

SEQ ID NO: 15196 - protein, 11 aa, Homo sapiens
KIKIIAPPERK

SEQ ID NO: 15197 - protein, 11 aa, Homo sapiens
KENERIEKERM

SEQ ID NO: 15198 - protein, 41 aa, Homo sapiens
MSKRPSYAPPPTPAPATQMPSTPGFVGYNPYSHLAYNNYRL

SEQ ID NO: 15199 - protein, 22 aa, Homo sapiens
RSPQVPAAQQMLNFPEKNKEKP

SEQ ID NO: 15200 - protein, 16 aa, Homo sapiens
KNVPSKSKAAASATRE

SEQ ID NO: 15201 - protein, 15 aa, Homo sapiens
KYLRLDGTTKAEDRG

SEQ ID NO: 15202 - protein, 21 aa, Homo sapiens
RKRPAPQQIQQVQQQAVQNRN

SEQ ID NO: 15203 - protein, 21 aa, Homo sapiens
RKRPAPQQIQQVQQQAVQNRN

SEQ ID NO: 15204 - protein, 25 aa, Homo sapiens
RDIGEGNLSTAAAAALAAAAVKAKH

SEQ ID NO: 15205 - protein, 11 aa, Homo sapiens
KMADKVLPQRI

SEQ ID NO: 15206 - protein, 16 aa, Homo sapiens
RLLEDSALSKYDATKQ

SEQ ID NO: 15207 - protein, 17 aa, Homo sapiens
RKFLESTDSFNNELKRL

SEQ ID NO: 15208 - protein, 17 aa, Homo sapiens
RKFLESTDSFNNELKRL

SEQ ID NO: 15209 - protein, 17 aa, Homo sapiens
RKFLESTDSFNNELKRL

SEQ ID NO: 15210 - protein, 23 aa, Homo sapiens
RTATTQETDGFQVKRPGDVNVRC

SEQ ID NO: 15211 - protein, 23 aa, Homo sapiens
RTATTQETDGFQVKRPGDVNVRC

SEQ ID NO: 15212 - protein, 19 aa, Homo sapiens
KAYHNSPAYLAYINAKSRA

SEQ ID NO: 15213 - protein, 20 aa, Homo sapiens
KTPPSMRLKLIANNTTVERR

SEQ ID NO: 15214 - protein, 20 aa, Homo sapiens
KTPPSMRLKLIANNTTVERR

SEQ ID NO: 15215 - protein, 22 aa, Homo sapiens
RKAQEAAAAVMQAAANSAQSRQ

SEQ ID NO: 15216 - protein, 31 aa, Homo sapiens; identical to SEQ ID NO: 6559

SEQ ID NO: 15217 - protein, 15 aa, Homo sapiens
RLKLIANNTTVERRF

SEQ ID NO: 15218 - protein, 13 aa, Homo sapiens
RELSQKTPPSMRL

SEQ ID NO: 15219 - protein, 37 aa, Homo sapiens
RGGTPGSGAAAAAGSKPPPSSSASASSSSSSFAQQRF

SEQ ID NO: 15220 - protein, 37 aa, Homo sapiens; identical to SEQ ID NO: 15219

SEQ ID NO: 15221 - protein, 37 aa, Homo sapiens; identical to SEQ ID NO: 15219

SEQ ID NO: 15222 - protein, 23 aa, Homo sapiens
RALLALAKVDENHSEFTLYESRL

SEQ ID NO: 15223 - protein, 23 aa, Homo sapiens
RALLALAKVDENHSEFTLYESRL

SEQ ID NO: 15224 - protein, 14 aa, Homo sapiens
RLKLIANNTTVERR

SEQ ID NO: 15225 - protein, 15 aa, Homo sapiens
RLKLIANNTTVERRF

SEQ ID NO: 15226 - protein, 18 aa, Homo sapiens
RKRDSDAGSSTPTTSTRS

SEQ ID NO: 15227 - protein, 18 aa, Homo sapiens
RKRDSDAGSSTPTTSTRS

SEQ ID NO: 15228 - protein, 15 aa, Homo sapiens
KQEYEEGGKQCVERK

SEQ ID NO: 15229 - protein, 14 aa, Homo sapiens
RLKLIANNTTVERR

SEQ ID NO: 15230 - protein, 14 aa, Homo sapiens
RLKLIANNTTVERR

SEQ ID NO: 15231 - protein, 28 aa, Homo sapiens
KVEHEISEGNVATAAAAALASAATKAKH

SEQ ID NO: 15232 - protein, 29 aa, Homo sapiens
KKVEHEISEGNVATAAAAALASAATKAKH

SEQ ID NO: 15233 - protein, 29 aa, Homo sapiens
KKVEHEISEGNVATAAAAALASAATKAKH

SEQ ID NO: 15234 - protein, 29 aa, Homo sapiens
KKVEHEISEGNVATAAAAALASAATKAKH

SEQ ID NO: 15235 - protein, 29 aa, Homo sapiens
KKVEHEISEGNVATAAAAALASAATKAKH

SEQ ID NO: 15236 - protein, 9 aa, Homo sapiens
KKVQEAARA

SEQ ID NO: 15237 - protein, 9 aa, Homo sapiens
KKVQEAARA

SEQ ID NO: 15238 - protein, 9 aa, Homo sapiens
KKVQEAARA

SEQ ID NO: 15239 - protein, 9 aa, Homo sapiens
KKVQEAARA

SEQ ID NO: 15240 - protein, 9 aa, Homo sapiens
KKVQEAARA

SEQ ID NO: 15241 - protein, 9 aa, Homo sapiens
KKVQEAARA

SEQ ID NO: 15242 - protein, 9 aa, Homo sapiens
KKVQEAARA

SEQ ID NO: 15243 - protein, 20 aa, Homo sapiens
RSPQVPAAQQMLNFPEKNKE

SEQ ID NO: 15244 - protein, 17 aa, Homo sapiens
RVASAAAKAALEEFSRV

SEQ ID NO: 15245 - protein, 21 aa, Homo sapiens
RKRPAPQQIQQVQQQAVQNRN

SEQ ID NO: 15246 - protein, 21 aa, Homo sapiens
RKRPAPQQIQQVQQQAVQNRN

SEQ ID NO: 15247 - protein, 27 aa, Homo sapiens
KPDTDQTLKKEGLISQDGSSLEALLRT

SEQ ID NO: 15248 - protein, 24 aa, Homo sapiens
RLPFLDSQTGVAQSNCYIWMEKRH

SEQ ID NO: 15249 - protein, 27 aa, Homo sapiens
KPDTDQTLKKEGLISQDGSSLEALLRT

SEQ ID NO: 15250 - protein, 27 aa, Homo sapiens
KPDTDQTLKKEGLISQDGSSLEALLRT

SEQ ID NO: 15251 - protein, 18 aa, Homo sapiens
KASEVEEILDGNDEKYKA

SEQ ID NO: 15252 - protein, 28 aa, Homo sapiens
RMEKGEPYMSIQPAEDPDDYDDGFSMKH

SEQ ID NO: 15253 - protein, 12 aa, Homo sapiens
RITEKLEKQQKI

SEQ ID NO: 15254 - protein, 12 aa, Homo sapiens
RNIKLLEDEPRS

SEQ ID NO: 15255 - protein, 12 aa, Homo sapiens
RQEKFYATLVRY

SEQ ID NO: 15256 - protein, 12 aa, Homo sapiens
RQEKFYATLVRY

SEQ ID NO: 15257 - protein, 12 aa, Homo sapiens
RQEKFYATLVRY

SEQ ID NO: 15258 - protein, 12 aa, Homo sapiens
RQEKFYATLVRY

SEQ ID NO: 15259 - protein, 13 aa, Homo sapiens
RYVGDRKNPVCRE

SEQ ID NO: 15260 - protein, 12 aa, Homo sapiens
RNIKLLEDEPRS

SEQ ID NO: 15261 - protein, 31 aa, Homo sapiens
KLSIQDNNVDLILATPPFSRQEKFYATLVRY

SEQ ID NO: 15262 - protein, 12 aa, Homo sapiens
RQEKFYATLVRY

SEQ ID NO: 15263 - protein, 12 aa, Homo sapiens
RQEKFYATLVRY

SEQ ID NO: 15264 - protein, 12 aa, Homo sapiens
RQEKFYATLVRY

SEQ ID NO: 15265 - protein, 16 aa, Homo sapiens
RMEIQEAIKKPLTQKR

SEQ ID NO: 15266 - protein, 20 aa, Homo sapiens
RDETPLCTIAHWQDSLAKRC

SEQ ID NO: 15267 - protein, 22 aa, Homo sapiens
RSRDETPLCTIAHWQDSLAKRC

SEQ ID NO: 15268 - protein, 22 aa, Homo sapiens
RSRDETPLCTIAHWQDSLAKRC

SEQ ID NO: 15269 - protein, 22 aa, Homo sapiens
RSRDETPLCTIAHWQDSLAKRC

SEQ ID NO: 15270 - protein, 20 aa, Homo sapiens
RDETPLCTIAHWQDSLAKRC

SEQ ID NO: 15271 - protein, 20 aa, Homo sapiens
RDETPLCTIAHWQDSLAKRC

SEQ ID NO: 15272 - protein, 20 aa, Homo sapiens
RDETPLCTIAHWQDSLAKRC

SEQ ID NO: 15273 - protein, 13 aa, Homo sapiens
RYVGDRKNPVCRE

SEQ ID NO: 15274 - protein, 13 aa, Homo sapiens
KLEKQQKIEQERK

SEQ ID NO: 15275 - protein, 19 aa, Homo sapiens
KAYHNSPAYLAYINAKSRA

SEQ ID NO: 15276 - protein, 19 aa, Homo sapiens
KAYHNSPAYLAYINAKSRA

SEQ ID NO: 15277 - protein, 29 aa, Homo sapiens
RKHVTTAEGTPGTTDQEGPPPDGPPEKRI

SEQ ID NO: 15278 - protein, 29 aa, Homo sapiens
RKHVTTAEGTPGTTDQEGPPPDGPPEKRI

SEQ ID NO: 15279 - protein, 29 aa, Homo sapiens
RKHVTTAEGTPGTTDQEGPPPDGPPEKRI

SEQ ID NO: 15280 - protein, 29 aa, Homo sapiens
RKHVTTAEGTPGTTDQEGPPPDGPPEKRI

SEQ ID NO: 15281 - protein, 29 aa, Homo sapiens
RKHVTTAEGTPGTTDQEGPPPDGPPEKRI

SEQ ID NO: 15282 - protein, 15 aa, Homo sapiens
RLTMKDIGTPEAWRV

SEQ ID NO: 15283 - protein, 31 aa, Homo sapiens
KLSIQDNNVDLILATPPFSRLEKLYSTMVRF

SEQ ID NO: 15284 - protein, 31 aa, Homo sapiens; identical to SEQ ID NO: 15283

SEQ ID NO: 15285 - protein, 31 aa, Homo sapiens; identical to SEQ ID NO: 15283

SEQ ID NO: 15286 - protein, 31 aa, Homo sapiens; identical to SEQ ID NO: 15283

SEQ ID NO: 15287 - protein, 12 aa, Homo sapiens
RLEKLYSTMVRF

SEQ ID NO: 15288 - protein, 12 aa, Homo sapiens
RLEKLYSTMVRF

SEQ ID NO: 15289 - protein, 31 aa, Homo sapiens; identical to SEQ ID NO: 15283

SEQ ID NO: 15290 - protein, 31 aa, Homo sapiens; identical to SEQ ID NO: 15283

SEQ ID NO: 15291 - protein, 31 aa, Homo sapiens; identical to SEQ ID NO: 15283

SEQ ID NO: 15292 - protein, 31 aa, Homo sapiens; identical to SEQ ID NO: 15283

SEQ ID NO: 15293 - protein, 16 aa, Homo sapiens
RMEIQEAIKKPLTQKR

SEQ ID NO: 15294 - protein, 16 aa, Homo sapiens
RMEIQEAIKKPLTQKR

SEQ ID NO: 15295 - protein, 16 aa, Homo sapiens
RMEIQEAIKKPLTQKR

SEQ ID NO: 15296 - protein, 16 aa, Homo sapiens
RMEIQEAIKKPLTQKR

SEQ ID NO: 15297 - protein, 16 aa, Homo sapiens
RMEIQEAIKKPLTQKR

SEQ ID NO: 15298 - protein, 16 aa, Homo sapiens
RMEIQEAIKKPLTQKR

SEQ ID NO: 15299 - protein, 16 aa, Homo sapiens
RMEIQEAIKKPLTQKR

SEQ ID NO: 15300 - protein, 16 aa, Homo sapiens
RMEIQEAIKKPLTQKR

SEQ ID NO: 15301 - protein, 16 aa, Homo sapiens
RMEIQEAIKKPLTQKR

SEQ ID NO: 15302 - protein, 16 aa, Homo sapiens
RMEIQEAIKKPLTQKR

SEQ ID NO: 15303 - protein, 13 aa, Homo sapiens
RFLSDRKNPVCRE

SEQ ID NO: 15304 - protein, 31 aa, Homo sapiens; identical to SEQ ID NO: 6760

SEQ ID NO: 15305 - protein, 23 aa, Homo sapiens
RSNSVGIQDAFNDGSDSTFQKRN

SEQ ID NO: 15306 - protein, 13 aa, Homo sapiens
RFLSDRKNPVCRE

SEQ ID NO: 15307 - protein, 12 aa, Homo sapiens
RLEKLYSTMVRF

SEQ ID NO: 15308 - protein, 12 aa, Homo sapiens
RLEKLYSTMVRF

SEQ ID NO: 15309 - protein, 12 aa, Homo sapiens
RLEKLYSTMVRF

SEQ ID NO: 15310 - protein, 12 aa, Homo sapiens
RLEKLYSTMVRF

SEQ ID NO: 15311 - protein, 12 aa, Homo sapiens
RLEKLYSTMVRF

SEQ ID NO: 15312 - protein, 12 aa, Homo sapiens
RLEKLYSTMVRF

SEQ ID NO: 15313 - protein, 31 aa, Homo sapiens; identical to SEQ ID NO: 15283

SEQ ID NO: 15314 - protein, 13 aa, Homo sapiens
RFLSDRKNPVCRE

SEQ ID NO: 15315 - protein, 13 aa, Homo sapiens
RFLSDRKNPVCRE

SEQ ID NO: 15316 - protein, 14 aa, Homo sapiens
RVDIQEALKRPMKQ

SEQ ID NO: 15317 - protein, 14 aa, Homo sapiens
RVDIQEALKRPMKQ

SEQ ID NO: 15318 - protein, 14 aa, Homo sapiens
RVDIQEALKRPMKQ

SEQ ID NO: 15319 - protein, 31 aa, Homo sapiens; identical to SEQ ID NO: 424

SEQ ID NO: 15320 - protein, 31 aa, Homo sapiens; identical to SEQ ID NO: 424

SEQ ID NO: 15321 - protein, 31 aa, Homo sapiens; identical to SEQ ID NO: 424

SEQ ID NO: 15322 - protein, 18 aa, Homo sapiens
KESSKFPFGISPAQSHRN

SEQ ID NO: 15323 - protein, 18 aa, Homo sapiens
KESSKFPFGISPAQSHRN

SEQ ID NO: 15324 - protein, 18 aa, Homo sapiens
KESSKFPFGISPAQSHRN

SEQ ID NO: 15325 - protein, 18 aa, Homo sapiens
KESSKFPFGISPAQSHRN

SEQ ID NO: 15326 - protein, 29 aa, Homo sapiens
KILEDEPHSKDETPLCTLLDWQDSLAKRC

SEQ ID NO: 15327 - protein, 29 aa, Homo sapiens
RKHVTTAEGTPGTTDQEGPPPDGPPEKRI

SEQ ID NO: 15328 - protein, 29 aa, Homo sapiens
RKHVTTAEGTPGTTDQEGPPPDGPPEKRI

SEQ ID NO: 15329 - protein, 29 aa, Homo sapiens
RKHVTTAEGTPGTTDQEGPPPDGPPEKRI

SEQ ID NO: 15330 - protein, 29 aa, Homo sapiens
RKHVTTAEGTPGTTDQEGPPPDGPPEKRI

SEQ ID NO: 15331 - protein, 29 aa, Homo sapiens
RKHVTTAEGTPGTTDQEGPPPDGPPEKRI

SEQ ID NO: 15332 - protein, 29 aa, Homo sapiens
RKHVTTAEGTPGTTDQEGPPPDGPPEKRI

SEQ ID NO: 15333 - protein, 29 aa, Homo sapiens
RKHVTTAEGTPGTTDQEGPPPDGPPEKRI

SEQ ID NO: 15334 - protein, 29 aa, Homo sapiens
RKHVTTAEGTPGTTDQEGPPPDGPPEKRI

SEQ ID NO: 15335 - protein, 37 aa, Homo sapiens; identical to SEQ ID NO: 15219

SEQ ID NO: 15336 - protein, 37 aa, Homo sapiens; identical to SEQ ID NO: 15219

SEQ ID NO: 15337 - protein, 23 aa, Homo sapiens
RSNSVGIQDAFNDGSDSTFQKRN

SEQ ID NO: 15338 - protein, 21 aa, Homo sapiens
RKRPAPQQIQQVQQQAVQNRN

SEQ ID NO: 15339 - protein, 21 aa, Homo sapiens
RKRPAPQQIQQVQQQAVQNRN

SEQ ID NO: 15340 - protein, 8 aa, Homo sapiens
RKNPVCRE

SEQ ID NO: 15341 - protein, 14 aa, Homo sapiens
RLDIQEALKRPIKQ

SEQ ID NO: 15342 - protein, 14 aa, Homo sapiens
RLDIQEALKRPIKQ

SEQ ID NO: 15343 - protein, 19 aa, Homo sapiens
KKKIPDPDSDDVSEVDARH

SEQ ID NO: 15344 - protein, 19 aa, Homo sapiens
KKKIPDPDSDDVSEVDARH

SEQ ID NO: 15345 - protein, 28 aa, Homo sapiens
RMEKGEPYMSIQPAEDPDDYDDGFSMKH

SEQ ID NO: 15346 - protein, 28 aa, Homo sapiens
RMEKGEPYMSIQPAEDPDDYDDGFSMKH

SEQ ID NO: 15347 - protein, 28 aa, Homo sapiens
RMEKGEPYMSIQPAEDPDDYDDGFSMKH

SEQ ID NO: 15348 - protein, 10 aa, Homo sapiens
RTKATIELKA

SEQ ID NO: 15349 - protein, 20 aa, Homo sapiens
RSPQVPAAQQMLNFPEKNKE

SEQ ID NO: 15350 - protein, 20 aa, Homo sapiens
RSPQVPAAQQMLNFPEKNKE

SEQ ID NO: 15351 - protein, 10 aa, Homo sapiens
RITPIQKPRG

SEQ ID NO: 15352 - protein, 17 aa, Homo sapiens
RVASAAAKAALEEFSRV

SEQ ID NO: 15353 - protein, 22 aa, Homo sapiens
RSPQVPAAQQMLNFPEKNKEKP

SEQ ID NO: 15354 - protein, 22 aa, Homo sapiens
RSPQVPAAQQMLNFPEKNKEKP

SEQ ID NO: 15355 - protein, 18 aa, Homo sapiens
RDLKTMTDVVGNPEEERR

SEQ ID NO: 15356 - protein, 12 aa, Homo sapiens
KVSYKGSPAARR

SEQ ID NO: 15357 - protein, 8 aa, Homo sapiens
REQKAKRN

SEQ ID NO: 15358 - protein, 9 aa, Homo sapiens
RAKDDIKKV

SEQ ID NO: 15359 - protein, 10 aa, Homo sapiens
RSRAKDDIKK

SEQ ID NO: 15360 - protein, 10 aa, Homo sapiens
RSVTGKIQKL

SEQ ID NO: 15361 - protein, 10 aa, Homo sapiens
KKVMATIEKV

SEQ ID NO: 15362 - protein, 9 aa, Homo sapiens
RAKDDIKKV

SEQ ID NO: 15363 - protein, 30 aa, Homo sapiens
AFASNLPTLNVAKAASSGPGKPSGLQYESK

SEQ ID NO: 15364 - protein, 14 aa, Homo sapiens
MQKEITALAPSTMK

SEQ ID NO: 15365 - protein, 14 aa, Homo sapiens
MQKEITALAPSTMK

SEQ ID NO: 15366 - protein, 19 aa, Homo sapiens
LDLAGRDLTDYLMKILTER

SEQ ID NO: 15367 - protein, 8 aa, Homo sapiens
EQKKENER

SEQ ID NO: 15368 - protein, 8 aa, Homo sapiens
EQKKENER

SEQ ID NO: 15369 - protein, 9 aa, Homo sapiens
IKIIAPPER

SEQ ID NO: 15370 - protein, 9 aa, Homo sapiens
ENERIEKER

SEQ ID NO: 15371 - protein, 40 aa, Homo sapiens
MSKRPSYAPPPTPAPATQMPSTPGFVGYNPYSHLAYNNYR

SEQ ID NO: 15372 - protein, 20 aa, Homo sapiens
SPQVPAAQQMLNFPEKNKEK

SEQ ID NO: 15373 - protein, 14 aa, Homo sapiens
NVPSKSKAAASATR

SEQ ID NO: 15374 - protein, 13 aa, Homo sapiens
YLRLDGTTKAEDR

SEQ ID NO: 15375 - protein, 19 aa, Homo sapiens
KRPAPQQIQQVQQQAVQNR

SEQ ID NO: 15376 - protein, 19 aa, Homo sapiens
KRPAPQQIQQVQQQAVQNR

SEQ ID NO: 15377 - protein, 23 aa, Homo sapiens
DIGEGNLSTAAAAALAAAAVKAK

SEQ ID NO: 15378 - protein, 9 aa, Homo sapiens
MADKVLPQR

SEQ ID NO: 15379 - protein, 14 aa, Homo sapiens
LLEDSALSKYDATK

SEQ ID NO: 15380 - protein, 15 aa, Homo sapiens
KFLESTDSFNNELKR

SEQ ID NO: 15381 - protein, 15 aa, Homo sapiens
KFLESTDSFNNELKR

SEQ ID NO: 15382 - protein, 15 aa, Homo sapiens
KFLESTDSFNNELKR

SEQ ID NO: 15383 - protein, 21 aa, Homo sapiens
TATTQETDGFQVKRPGDVNVR

SEQ ID NO: 15384 - protein, 21 aa, Homo sapiens
TATTQETDGFQVKRPGDVNVR

SEQ ID NO: 15385 - protein, 17 aa, Homo sapiens
AYHNSPAYLAYINAKSR

SEQ ID NO: 15386 - protein, 18 aa, Homo sapiens
TPPSMRLKLIANNTTVER

SEQ ID NO: 15387 - protein, 18 aa, Homo sapiens
TPPSMRLKLIANNTTVER

SEQ ID NO: 15388 - protein, 20 aa, Homo sapiens
KAQEAAAAVMQAAANSAQSR

SEQ ID NO: 15389 - protein, 29 aa, Homo sapiens
DDGSTLMEIDGDKGKQGGPTYYIDTNALR

SEQ ID NO: 15390 - protein, 13 aa, Homo sapiens
LKLIANNTTVERR

SEQ ID NO: 15391 - protein, 11 aa, Homo sapiens
ELSQKTPPSMR

SEQ ID NO: 15392 - protein, 35 aa, Homo sapiens
GGTPGSGAAAAAGSKPPPSSSASASSSSSSFAQQR

SEQ ID NO: 15393 - protein, 35 aa, Homo sapiens; identical to SEQ ID NO: 15392

SEQ ID NO: 15394 - protein, 35 aa, Homo sapiens; identical to SEQ ID NO: 15392

SEQ ID NO: 15395 - protein, 21 aa, Homo sapiens
ALLALAKVDENHSEFTLYESR

SEQ ID NO: 15396 - protein, 21 aa, Homo sapiens
ALLALAKVDENHSEFTLYESR

SEQ ID NO: 15397 - protein, 12 aa, Homo sapiens
LKLIANNTTVER

SEQ ID NO: 15398 - protein, 13 aa, Homo sapiens
LKLIANNTTVERR

SEQ ID NO: 15399 - protein, 16 aa, Homo sapiens
KRDSDAGSSTPTTSTR

SEQ ID NO: 15400 - protein, 16 aa, Homo sapiens
KRDSDAGSSTPTTSTR

SEQ ID NO: 15401 - protein, 13 aa, Homo sapiens
QEYEEGGKQCVER

SEQ ID NO: 15402 - protein, 12 aa, Homo sapiens
LKLIANNTTVER

SEQ ID NO: 15403 - protein, 12 aa, Homo sapiens
LKLIANNTTVER

SEQ ID NO: 15404 - protein, 26 aa, Homo sapiens
VEHEISEGNVATAAAAALASAATKAK

SEQ ID NO: 15405 - protein, 27 aa, Homo sapiens
KVEHEISEGNVATAAAAALASAATKAK

SEQ ID NO: 15406 - protein, 27 aa, Homo sapiens
KVEHEISEGNVATAAAAALASAATKAK

SEQ ID NO: 15407 - protein, 27 aa, Homo sapiens
KVEHEISEGNVATAAAAALASAATKAK

SEQ ID NO: 15408 - protein, 27 aa, Homo sapiens
KVEHEISEGNVATAAAAALASAATKAK

SEQ ID NO: 15409 - protein, 7 aa, Homo sapiens
KVQEAAR

SEQ ID NO: 15410 - protein, 7 aa, Homo sapiens
KVQEAAR

SEQ ID NO: 15411 - protein, 7 aa, Homo sapiens
KVQEAAR

SEQ ID NO: 15412 - protein, 7 aa, Homo sapiens
KVQEAAR

SEQ ID NO: 15413 - protein, 7 aa, Homo sapiens
KVQEAAR

SEQ ID NO: 15414 - protein, 7 aa, Homo sapiens
KVQEAAR

SEQ ID NO: 15415 - protein, 7 aa, Homo sapiens
KVQEAAR

SEQ ID NO: 15416 - protein, 18 aa, Homo sapiens
SPQVPAAQQMLNFPEKNK

SEQ ID NO: 15417 - protein, 15 aa, Homo sapiens
VASAAAKAALEEFSR

SEQ ID NO: 15418 - protein, 19 aa, Homo sapiens
KRPAPQQIQQVQQQAVQNR

SEQ ID NO: 15419 - protein, 19 aa, Homo sapiens
KRPAPQQIQQVQQQAVQNR

SEQ ID NO: 15420 - protein, 25 aa, Homo sapiens
PDTDQTLKKEGLISQDGSSLEALLR

SEQ ID NO: 15421 - protein, 22 aa, Homo sapiens
LPFLDSQTGVAQSNCYIWMEKR

SEQ ID NO: 15422 - protein, 25 aa, Homo sapiens
PDTDQTLKKEGLISQDGSSLEALLR

SEQ ID NO: 15423 - protein, 25 aa, Homo sapiens
PDTDQTLKKEGLISQDGSSLEALLR

SEQ ID NO: 15424 - protein, 16 aa, Homo sapiens
ASEVEEILDGNDEKYK

SEQ ID NO: 15425 - protein, 26 aa, Homo sapiens
MEKGEPYMSIQPAEDPDDYDDGFSMK

SEQ ID NO: 15426 - protein, 10 aa, Homo sapiens
ITEKLEKQQK

SEQ ID NO: 15427 - protein, 10 aa, Homo sapiens
NIKLLEDEPR

SEQ ID NO: 15428 - protein, 10 aa, Homo sapiens
QEKFYATLVR

SEQ ID NO: 15429 - protein, 10 aa, Homo sapiens
QEKFYATLVR

SEQ ID NO: 15430 - protein, 10 aa, Homo sapiens
QEKFYATLVR

SEQ ID NO: 15431 - protein, 10 aa, Homo sapiens
QEKFYATLVR

SEQ ID NO: 15432 - protein, 11 aa, Homo sapiens
YVGDRKNPVCR

SEQ ID NO: 15433 - protein, 10 aa, Homo sapiens
NIKLLEDEPR

SEQ ID NO: 15434 - protein, 29 aa, Homo sapiens
LSIQDNNVDLILATPPFSRQEKFYATLVR

SEQ ID NO: 15435 - protein, 10 aa, Homo sapiens
QEKFYATLVR

SEQ ID NO: 15436 - protein, 10 aa, Homo sapiens
QEKFYATLVR

SEQ ID NO: 15437 - protein, 10 aa, Homo sapiens
QEKFYATLVR

SEQ ID NO: 15438 - protein, 14 aa, Homo sapiens
MEIQEAIKKPLTQK

SEQ ID NO: 15439 - protein, 18 aa, Homo sapiens
DETPLCTIAHWQDSLAKR

SEQ ID NO: 15440 - protein, 20 aa, Homo sapiens
SRDETPLCTIAHWQDSLAKR

SEQ ID NO: 15441 - protein, 20 aa, Homo sapiens
SRDETPLCTIAHWQDSLAKR

SEQ ID NO: 15442 - protein, 20 aa, Homo sapiens
SRDETPLCTIAHWQDSLAKR

SEQ ID NO: 15443 - protein, 18 aa, Homo sapiens
DETPLCTIAHWQDSLAKR

SEQ ID NO: 15444 - protein, 18 aa, Homo sapiens
DETPLCTIAHWQDSLAKR

SEQ ID NO: 15445 - protein, 18 aa, Homo sapiens
DETPLCTIAHWQDSLAKR

SEQ ID NO: 15446 - protein, 11 aa, Homo sapiens
YVGDRKNPVCR

SEQ ID NO: 15447 - protein, 11 aa, Homo sapiens
LEKQQKIEQER

SEQ ID NO: 15448 - protein, 17 aa, Homo sapiens
AYHNSPAYLAYINAKSR

SEQ ID NO: 15449 - protein, 17 aa, Homo sapiens
AYHNSPAYLAYINAKSR

SEQ ID NO: 15450 - protein, 27 aa, Homo sapiens
KHVTTAEGTPGTTDQEGPPPDGPPEKR

SEQ ID NO: 15451 - protein, 27 aa, Homo sapiens
KHVTTAEGTPGTTDQEGPPPDGPPEKR

SEQ ID NO: 15452 - protein, 27 aa, Homo sapiens
KHVTTAEGTPGTTDQEGPPPDGPPEKR

SEQ ID NO: 15453 - protein, 27 aa, Homo sapiens
KHVTTAEGTPGTTDQEGPPPDGPPEKR

SEQ ID NO: 15454 - protein, 27 aa, Homo sapiens
KHVTTAEGTPGTTDQEGPPPDGPPEKR

SEQ ID NO: 15455 - protein, 13 aa, Homo sapiens
LTMKDIGTPEAWR

SEQ ID NO: 15456 - protein, 29 aa, Homo sapiens
LSIQDNNVDLILATPPFSRLEKLYSTMVR

SEQ ID NO: 15457 - protein, 29 aa, Homo sapiens
LSIQDNNVDLILATPPFSRLEKLYSTMVR

SEQ ID NO: 15458 - protein, 29 aa, Homo sapiens
LSIQDNNVDLILATPPFSRLEKLYSTMVR

SEQ ID NO: 15459 - protein, 29 aa, Homo sapiens
LSIQDNNVDLILATPPFSRLEKLYSTMVR

SEQ ID NO: 15460 - protein, 10 aa, Homo sapiens
LEKLYSTMVR

SEQ ID NO: 15461 - protein, 10 aa, Homo sapiens
LEKLYSTMVR

SEQ ID NO: 15462 - protein, 29 aa, Homo sapiens
LSIQDNNVDLILATPPFSRLEKLYSTMVR

SEQ ID NO: 15463 - protein, 29 aa, Homo sapiens
LSIQDNNVDLILATPPFSRLEKLYSTMVR

SEQ ID NO: 15464 - protein, 29 aa, Homo sapiens
LSIQDNNVDLILATPPFSRLEKLYSTMVR

SEQ ID NO: 15465 - protein, 29 aa, Homo sapiens
LSIQDNNVDLILATPPFSRLEKLYSTMVR

SEQ ID NO: 15466 - protein, 14 aa, Homo sapiens
MEIQEAIKKPLTQK

SEQ ID NO: 15467 - protein, 14 aa, Homo sapiens
MEIQEAIKKPLTQK

SEQ ID NO: 15468 - protein, 14 aa, Homo sapiens
MEIQEAIKKPLTQK

SEQ ID NO: 15469 - protein, 14 aa, Homo sapiens
MEIQEAIKKPLTQK

SEQ ID NO: 15470 - protein, 14 aa, Homo sapiens
MEIQEAIKKPLTQK

SEQ ID NO: 15471 - protein, 14 aa, Homo sapiens
MEIQEAIKKPLTQK

SEQ ID NO: 15472 - protein, 14 aa, Homo sapiens
MEIQEAIKKPLTQK

SEQ ID NO: 15473 - protein, 14 aa, Homo sapiens
MEIQEAIKKPLTQK

SEQ ID NO: 15474 - protein, 14 aa, Homo sapiens
MEIQEAIKKPLTQK

SEQ ID NO: 15475 - protein, 14 aa, Homo sapiens
MEIQEAIKKPLTQK

SEQ ID NO: 15476 - protein, 11 aa, Homo sapiens
FLSDRKNPVCR

SEQ ID NO: 15477 - protein, 29 aa, Homo sapiens
TFGQKPVKFQLEDDGEFYMIGSEVGNYLR

SEQ ID NO: 15478 - protein, 21 aa, Homo sapiens
SNSVGIQDAFNDGSDSTFQKR

SEQ ID NO: 15479 - protein, 11 aa, Homo sapiens
FLSDRKNPVCR

SEQ ID NO: 15480 - protein, 10 aa, Homo sapiens
LEKLYSTMVR

SEQ ID NO: 15481 - protein, 10 aa, Homo sapiens
LEKLYSTMVR

SEQ ID NO: 15482 - protein, 10 aa, Homo sapiens
LEKLYSTMVR

SEQ ID NO: 15483 - protein, 10 aa, Homo sapiens
LEKLYSTMVR

SEQ ID NO: 15484 - protein, 10 aa, Homo sapiens
LEKLYSTMVR

SEQ ID NO: 15485 - protein, 10 aa, Homo sapiens
LEKLYSTMVR

SEQ ID NO: 15486 - protein, 29 aa, Homo sapiens
LSIQDNNVDLILATPPFSRLEKLYSTMVR

SEQ ID NO: 15487 - protein, 11 aa, Homo sapiens
FLSDRKNPVCR

SEQ ID NO: 15488 - protein, 11 aa, Homo sapiens
FLSDRKNPVCR

SEQ ID NO: 15489 - protein, 12 aa, Homo sapiens
VDIQEALKRPMK

SEQ ID NO: 15490 - protein, 12 aa, Homo sapiens
VDIQEALKRPMK

SEQ ID NO: 15491 - protein, 12 aa, Homo sapiens
VDIQEALKRPMK

SEQ ID NO: 15492 - protein, 29 aa, Homo sapiens
NIKILEDEPHSKDETPLCTLLDWQDSLAK

SEQ ID NO: 15493 - protein, 29 aa, Homo sapiens
NIKILEDEPHSKDETPLCTLLDWQDSLAK

SEQ ID NO: 15494 - protein, 29 aa, Homo sapiens
NIKILEDEPHSKDETPLCTLLDWQDSLAK

SEQ ID NO: 15495 - protein, 16 aa, Homo sapiens
ESSKFPFGISPAQSHR

SEQ ID NO: 15496 - protein, 16 aa, Homo sapiens
ESSKFPFGISPAQSHR

SEQ ID NO: 15497 - protein, 16 aa, Homo sapiens
ESSKFPFGISPAQSHR

SEQ ID NO: 15498 - protein, 16 aa, Homo sapiens
ESSKFPFGISPAQSHR

SEQ ID NO: 15499 - protein, 27 aa, Homo sapiens
ILEDEPHSKDETPLCTLLDWQDSLAKR

SEQ ID NO: 15500 - protein, 27 aa, Homo sapiens
KHVTTAEGTPGTTDQEGPPPDGPPEKR

SEQ ID NO: 15501 - protein, 27 aa, Homo sapiens
KHVTTAEGTPGTTDQEGPPPDGPPEKR

SEQ ID NO: 15502 - protein, 27 aa, Homo sapiens
KHVTTAEGTPGTTDQEGPPPDGPPEKR

SEQ ID NO: 15503 - protein, 27 aa, Homo sapiens
KHVTTAEGTPGTTDQEGPPPDGPPEKR

SEQ ID NO: 15504 - protein, 27 aa, Homo sapiens
KHVTTAEGTPGTTDQEGPPPDGPPEKR

SEQ ID NO: 15505 - protein, 27 aa, Homo sapiens
KHVTTAEGTPGTTDQEGPPPDGPPEKR

SEQ ID NO: 15506 - protein, 27 aa, Homo sapiens
KHVTTAEGTPGTTDQEGPPPDGPPEKR

SEQ ID NO: 15507 - protein, 27 aa, Homo sapiens
KHVTTAEGTPGTTDQEGPPPDGPPEKR

SEQ ID NO: 15508 - protein, 35 aa, Homo sapiens; identical to SEQ ID NO: 15392

SEQ ID NO: 15509 - protein, 35 aa, Homo sapiens; identical to SEQ ID NO: 15392

SEQ ID NO: 15510 - protein, 21 aa, Homo sapiens
SNSVGIQDAFNDGSDSTFQKR

SEQ ID NO: 15511 - protein, 19 aa, Homo sapiens
KRPAPQQIQQVQQQAVQNR

SEQ ID NO: 15512 - protein, 19 aa, Homo sapiens
KRPAPQQIQQVQQQAVQNR

SEQ ID NO: 15513 - protein, 6 aa, Homo sapiens
KNPVCR

SEQ ID NO: 15514 - protein, 12 aa, Homo sapiens
LDIQEALKRPIK

SEQ ID NO: 15515 - protein, 12 aa, Homo sapiens
LDIQEALKRPIK

SEQ ID NO: 15516 - protein, 17 aa, Homo sapiens
KKIPDPDSDDVSEVDAR

SEQ ID NO: 15517 - protein, 17 aa, Homo sapiens
KKIPDPDSDDVSEVDAR

SEQ ID NO: 15518 - protein, 26 aa, Homo sapiens
MEKGEPYMSIQPAEDPDDYDDGFSMK

SEQ ID NO: 15519 - protein, 26 aa, Homo sapiens
MEKGEPYMSIQPAEDPDDYDDGFSMK

SEQ ID NO: 15520 - protein, 26 aa, Homo sapiens
MEKGEPYMSIQPAEDPDDYDDGFSMK

SEQ ID NO: 15521 - protein, 8 aa, Homo sapiens
TKATIELK

SEQ ID NO: 15522 - protein, 18 aa, Homo sapiens
SPQVPAAQQMLNFPEKNK

SEQ ID NO: 15523 - protein, 18 aa, Homo sapiens
SPQVPAAQQMLNFPEKNK

SEQ ID NO: 15524 - protein, 8 aa, Homo sapiens
ITPIQKPR

SEQ ID NO: 15525 - protein, 15 aa, Homo sapiens
VASAAAKAALEEFSR

SEQ ID NO: 15526 - protein, 20 aa, Homo sapiens
SPQVPAAQQMLNFPEKNKEK

SEQ ID NO: 15527 - protein, 20 aa, Homo sapiens
SPQVPAAQQMLNFPEKNKEK

SEQ ID NO: 15528 - protein, 16 aa, Homo sapiens
DLKTMTDVVGNPEEER

SEQ ID NO: 15529 - protein, 10 aa, Homo sapiens
VSYKGSPAAR

SEQ ID NO: 15530 - protein, 6 aa, Homo sapiens
EQKAKR

SEQ ID NO: 15531 - protein, 7 aa, Homo sapiens
AKDDIKK

SEQ ID NO: 15532 - protein, 8 aa, Homo sapiens
SRAKDDIK

SEQ ID NO: 15533 - protein, 8 aa, Homo sapiens
SVTGKIQK

SEQ ID NO: 15534 - protein, 8 aa, Homo sapiens
KVMATIEK

SEQ ID NO: 15535 - protein, 7 aa, Homo sapiens
AKDDIKK

SEQ ID NO: 15536 - protein, 20 aa, Homo sapiens
KTPPSMRLKLIANNTTVERR

SEQ ID NO: 15537 - protein, 11 aa, Homo sapiens
REGSPANWKRK

SEQ ID NO: 15538 - protein, 11 aa, Homo sapiens
REGSPANWKRK

SEQ ID NO: 15539 - protein, 10 aa, Homo sapiens
KEKLPQVTRS

SEQ ID NO: 15540 - protein, 11 aa, Homo sapiens
KIKIIAPPERK

SEQ ID NO: 15541 - protein, 11 aa, Homo sapiens
KIKIIAPPERK

SEQ ID NO: 15542 - protein, 7 aa, Homo sapiens
KKENERI

SEQ ID NO: 15543 - protein, 11 aa, Homo sapiens
KIKIIAPPERK

SEQ ID NO: 15544 - protein, 13 aa, Homo sapiens
KKTDVAECGPGGS

SEQ ID NO: 15545 - protein, 10 aa, Homo sapiens
KEDVEKAKKR

SEQ ID NO: 15546 - protein, 10 aa, Homo sapiens
KQQKIEQERK

SEQ ID NO: 15547 - protein, 6 aa, Homo sapiens
KKNIRK

SEQ ID NO: 15548 - protein, 19 aa, Homo sapiens
RNLVFRDFTDEKEGPITKH

SEQ ID NO: 15549 - protein, 19 aa, Homo sapiens
RNLVFRDFTDEKEGPITKH

SEQ ID NO: 15550 - protein, 8 aa, Homo sapiens
RMQVLKRQ

SEQ ID NO: 15551 - protein, 6 aa, Homo sapiens
MAVRKK

SEQ ID NO: 15552 - protein, 7 aa, Homo sapiens
RHQEKKR

SEQ ID NO: 15553 - protein, 16 aa, Homo sapiens
RLLEDSALSKYDATKQ

SEQ ID NO: 15554 - protein, 16 aa, Homo sapiens
RLLEDSALSKYDATKQ

SEQ ID NO: 15555 - protein, 16 aa, Homo sapiens
RLLEDSALSKYDATKQ

SEQ ID NO: 15556 - protein, 14 aa, Homo sapiens
RGKGEITPAAIQKM

SEQ ID NO: 15557 - protein, 14 aa, Homo sapiens
RGKGEITPAAIQKM

SEQ ID NO: 15558 - protein, 14 aa, Homo sapiens
RLKLIANNTTVERR

SEQ ID NO: 15559 - protein, 12 aa, Homo sapiens
RAAKALLAMARV

SEQ ID NO: 15560 - protein, 12 aa, Homo sapiens
RAAKALLAMARV

SEQ ID NO: 15561 - protein, 13 aa, Homo sapiens
RELSQKTPPSMRL

SEQ ID NO: 15562 - protein, 20 aa, Homo sapiens
KGVACSKDEWWWDCLEVLRD

SEQ ID NO: 15563 - protein, 9 aa, Homo sapiens
RKASANARK

SEQ ID NO: 15564 - protein, 9 aa, Homo sapiens
RKASANARK

SEQ ID NO: 15565 - protein, 13 aa, Homo sapiens
RELSQKTPPSMRL

SEQ ID NO: 15566 - protein, 13 aa, Homo sapiens
RELSQKTPPSMRL

SEQ ID NO: 15567 - protein, 13 aa, Homo sapiens
RELSQKTPPSMRL

SEQ ID NO: 15568 - protein, 15 aa, Homo sapiens
KQEYEEGGKQCVERK

SEQ ID NO: 15569 - protein, 15 aa, Homo sapiens
KQEYEEGGKQCVERK

SEQ ID NO: 15570 - protein, 12 aa, Homo sapiens
KVSYKGSPAARR

SEQ ID NO: 15571 - protein, 12 aa, Homo sapiens
KVSYKGSPAARR

SEQ ID NO: 15572 - protein, 14 aa, Homo sapiens
RLKLIANNTTVERR

SEQ ID NO: 15573 - protein, 13 aa, Homo sapiens
RELSQKTPPSMRL

SEQ ID NO: 15574 - protein, 12 aa, Homo sapiens
KTHKLQDPHERE

SEQ ID NO: 15575 - protein, 9 aa, Homo sapiens
KDFKEYHRS

SEQ ID NO: 15576 - protein, 9 aa, Homo sapiens
KDFKEYHRS

SEQ ID NO: 15577 - protein, 8 aa, Homo sapiens
RMQVLKRQ

SEQ ID NO: 15578 - protein, 8 aa, Homo sapiens
RMQVLKRQ

SEQ ID NO: 15579 - protein, 8 aa, Homo sapiens
RMQVLKRQ

SEQ ID NO: 15580 - protein, 8 aa, Homo sapiens
RMQVLKRQ

SEQ ID NO: 15581 - protein, 8 aa, Homo sapiens
RMQVLKRQ

SEQ ID NO: 15582 - protein, 8 aa, Homo sapiens
RMQVLKRQ

SEQ ID NO: 15583 - protein, 8 aa, Homo sapiens
RMQVLKRQ

SEQ ID NO: 15584 - protein, 8 aa, Homo sapiens
RMQVLKRQ

SEQ ID NO: 15585 - protein, 8 aa, Homo sapiens
RMQVLKRQ

SEQ ID NO: 15586 - protein, 8 aa, Homo sapiens
KKNVPSKS

SEQ ID NO: 15587 - protein, 8 aa, Homo sapiens
KKNVPSKS

SEQ ID NO: 15588 - protein, 8 aa, Homo sapiens
RKTKVERD

SEQ ID NO: 15589 - protein, 14 aa, Homo sapiens
KEKPTDMQNFGLRT

SEQ ID NO: 15590 - protein, 7 aa, Homo sapiens
KTKVERD

SEQ ID NO: 15591 - protein, 9 aa, Homo sapiens
RTDIYSKKT

SEQ ID NO: 15592 - protein, 9 aa, Homo sapiens
RTDIYSKKT

SEQ ID NO: 15593 - protein, 17 aa, Homo sapiens
RKFLESTDSFNNELKRL

SEQ ID NO: 15594 - protein, 15 aa, Homo sapiens
KNKSKTPEIYLAYRN

SEQ ID NO: 15595 - protein, 18 aa, Homo sapiens
KKDGFTSESTTLEALLRG

SEQ ID NO: 15596 - protein, 18 aa, Homo sapiens
KKDGFTSESTTLEALLRG

SEQ ID NO: 15597 - protein, 16 aa, Homo sapiens
KNKEKPVDLQNFGLRT

SEQ ID NO: 15598 - protein, 20 aa, Homo sapiens
RSLENRMSPSKSPFLPSMKM

SEQ ID NO: 15599 - protein, 12 aa, Homo sapiens
RAAKALLAMARV

SEQ ID NO: 15600 - protein, 11 aa, Homo sapiens
RKLDQTIMRKR

SEQ ID NO: 15601 - protein, 10 aa, Homo sapiens
RKLDQTIMRK

SEQ ID NO: 15602 - protein, 11 aa, Homo sapiens
RKLDQTIMRKR

SEQ ID NO: 15603 - protein, 10 aa, Homo sapiens
RKLDQTIMRK

SEQ ID NO: 15604 - protein, 10 aa, Homo sapiens
RKLDQTIMRK

SEQ ID NO: 15605 - protein, 7 aa, Homo sapiens
RKMADKV

SEQ ID NO: 15606 - protein, 10 aa, Homo sapiens
RKLDQTIARK

SEQ ID NO: 15607 - protein, 10 aa, Homo sapiens
RKLDQTIARK

SEQ ID NO: 15608 - protein, 10 aa, Homo sapiens
RKLDQTIARK

SEQ ID NO: 15609 - protein, 10 aa, Homo sapiens
RKLDQTIARK

SEQ ID NO: 15610 - protein, 10 aa, Homo sapiens
RKLDQTIARK

SEQ ID NO: 15611 - protein, 13 aa, Homo sapiens
RYVGDRKNPVCRE

SEQ ID NO: 15612 - protein, 19 aa, Homo sapiens
RDLKIITDVIGNPEEERRA

SEQ ID NO: 15613 - protein, 19 aa, Homo sapiens
RDLKIITDVIGNPEEERRA

SEQ ID NO: 15614 - protein, 18 aa, Homo sapiens
RDLKIITDVIGNPEEERR

SEQ ID NO: 15615 - protein, 19 aa, Homo sapiens
RDLKIITDVIGNPEEERRA

SEQ ID NO: 15616 - protein, 19 aa, Homo sapiens
RDLKIITDVIGNPEEERRA

SEQ ID NO: 15617 - protein, 19 aa, Homo sapiens
RDLKIITDVIGNPEEERRA

SEQ ID NO: 15618 - protein, 18 aa, Homo sapiens
RDLKIITDVIGNPEEERR

SEQ ID NO: 15619 - protein, 8 aa, Homo sapiens
RNHNAKKK

SEQ ID NO: 15620 - protein, 12 aa, Homo sapiens
RAAKALLAMARV

SEQ ID NO: 15621 - protein, 15 aa, Homo sapiens
RLTMKDIGTPEAWRV

SEQ ID NO: 15622 - protein, 15 aa, Homo sapiens
RLTMKDIGTPEAWRV

SEQ ID NO: 15623 - protein, 9 aa, Homo sapiens
KKVQEAARA

SEQ ID NO: 15624 - protein, 9 aa, Homo sapiens
KKVQEAARA

SEQ ID NO: 15625 - protein, 12 aa, Homo sapiens
KAKHLAAVEERK

SEQ ID NO: 15626 - protein, 17 aa, Homo sapiens
RVASAAAKAALEEFSRV

SEQ ID NO: 15627 - protein, 9 aa, Homo sapiens
RTDIYSKKT

SEQ ID NO: 15628 - protein, 11 aa, Homo sapiens
REKEALEQQRQ

SEQ ID NO: 15629 - protein, 10 aa, Homo sapiens
RKLDQTIARK

SEQ ID NO: 15630 - protein, 10 aa, Homo sapiens
RKLDQTIARK

SEQ ID NO: 15631 - protein, 10 aa, Homo sapiens
RKLDQTIARK

SEQ ID NO: 15632 - protein, 10 aa, Homo sapiens
RKLDQTIARK

SEQ ID NO: 15633 - protein, 10 aa, Homo sapiens
RKLDQTIARK

SEQ ID NO: 15634 - protein, 10 aa, Homo sapiens
RKLDQTIARK

SEQ ID NO: 15635 - protein, 10 aa, Homo sapiens
RKLDQTIARK

SEQ ID NO: 15636 - protein, 10 aa, Homo sapiens
RKLDQTIARK

SEQ ID NO: 15637 - protein, 10 aa, Homo sapiens
RKLDQTIARK

SEQ ID NO: 15638 - protein, 10 aa, Homo sapiens
RKLDQTIARK

SEQ ID NO: 15639 - protein, 8 aa, Homo sapiens
RKNPVCRE

SEQ ID NO: 15640 - protein, 8 aa, Homo sapiens
RKNPVCRE

SEQ ID NO: 15641 - protein, 8 aa, Homo sapiens
RKNPVCRE

SEQ ID NO: 15642 - protein, 8 aa, Homo sapiens
RKNPVCRE

SEQ ID NO: 15643 - protein, 13 aa, Homo sapiens
RFLSDRKNPVCRE

SEQ ID NO: 15644 - protein, 8 aa, Homo sapiens
RKNPVCRE

SEQ ID NO: 15645 - protein, 8 aa, Homo sapiens
RKNPVCRE

SEQ ID NO: 15646 - protein, 8 aa, Homo sapiens
RKNPVCRE

SEQ ID NO: 15647 - protein, 13 aa, Homo sapiens
RFLSDRKNPVCRE

SEQ ID NO: 15648 - protein, 8 aa, Homo sapiens
RKNPVCRE

SEQ ID NO: 15649 - protein, 11 aa, Homo sapiens
KMADKVLPQRI

SEQ ID NO: 15650 - protein, 29 aa, Homo sapiens
RKHVTTAEGTPGTTDQEGPPPDGPPEKRI

SEQ ID NO: 15651 - protein, 14 aa, Homo sapiens
RGKGEITPAAIQKM

SEQ ID NO: 15652 - protein, 14 aa, Homo sapiens
RGKGEITPAAIQKM

SEQ ID NO: 15653 - protein, 11 aa, Homo sapiens
RKLDQTIMRKR

SEQ ID NO: 15654 - protein, 10 aa, Homo sapiens
RKLDQTIMRK

SEQ ID NO: 15655 - protein, 10 aa, Homo sapiens
RKLDQTIMRK

SEQ ID NO: 15656 - protein, 10 aa, Homo sapiens
RKLDQTIMRK

SEQ ID NO: 15657 - protein, 11 aa, Homo sapiens
RKLDQTIMRKR

SEQ ID NO: 15658 - protein, 10 aa, Homo sapiens
RKLDQTIMRK

SEQ ID NO: 15659 - protein, 10 aa, Homo sapiens
RKLDQTIMRK

SEQ ID NO: 15660 - protein, 7 aa, Homo sapiens
RKMADKV

SEQ ID NO: 15661 - protein, 7 aa, Homo sapiens
RKMADKV

SEQ ID NO: 15662 - protein, 8 aa, Homo sapiens
RKNPVCRE

SEQ ID NO: 15663 - protein, 8 aa, Homo sapiens
RKNPVCRE

SEQ ID NO: 15664 - protein, 8 aa, Homo sapiens
RKNPVCRE

SEQ ID NO: 15665 - protein, 10 aa, Homo sapiens
RKLDQTIMRK

SEQ ID NO: 15666 - protein, 10 aa, Homo sapiens
RKLDQTIMRK

SEQ ID NO: 15667 - protein, 10 aa, Homo sapiens
RKLDQTIMRK

SEQ ID NO: 15668 - protein, 16 aa, Homo sapiens
RKYSDSSLPPSNSGKI

SEQ ID NO: 15669 - protein, 16 aa, Homo sapiens
RKYSDSSLPPSNSGKI

SEQ ID NO: 15670 - protein, 16 aa, Homo sapiens
RKYSDSSLPPSNSGKI

SEQ ID NO: 15671 - protein, 16 aa, Homo sapiens
RKYSDSSLPPSNSGKI

SEQ ID NO: 15672 - protein, 17 aa, Homo sapiens
RDTALETALNAKAYKRS

SEQ ID NO: 15673 - protein, 9 aa, Homo sapiens
RKVEEAAKV

SEQ ID NO: 15674 - protein, 9 aa, Homo sapiens
RKVEEAAKV

SEQ ID NO: 15675 - protein, 9 aa, Homo sapiens
RKVEEAAKV

SEQ ID NO: 15676 - protein, 17 aa, Homo sapiens
RVASAAAKSALEEFSKM

SEQ ID NO: 15677 - protein, 17 aa, Homo sapiens
RVASAAAKSALEEFSKM

SEQ ID NO: 15678 - protein, 9 aa, Homo sapiens
RTDMYTKKN

SEQ ID NO: 15679 - protein, 9 aa, Homo sapiens
RTDMYTKKN

SEQ ID NO: 15680 - protein, 9 aa, Homo sapiens
RTDMYTKKN

SEQ ID NO: 15681 - protein, 21 aa, Homo sapiens
RKRPAPQQIQQVQQQAVQNRN

SEQ ID NO: 15682 - protein, 21 aa, Homo sapiens
RKRPAPQQIQQVQQQAVQNRN

SEQ ID NO: 15683 - protein, 21 aa, Homo sapiens
RKRPAPQQIQQVQQQAVQNRN

SEQ ID NO: 15684 - protein, 16 aa, Homo sapiens
RMSYEPNKDPYGSMRK

SEQ ID NO: 15685 - protein, 16 aa, Homo sapiens
RMSYEPNKDPYGSMRK

SEQ ID NO: 15686 - protein, 8 aa, Homo sapiens
RNHNAKKK

SEQ ID NO: 15687 - protein, 8 aa, Homo sapiens
RKNPVCRE

SEQ ID NO: 15688 - protein, 8 aa, Homo sapiens
RKNPVCRE

SEQ ID NO: 15689 - protein, 7 aa, Homo sapiens
KKVDARE

SEQ ID NO: 15690 - protein, 7 aa, Homo sapiens
KKVDARE

SEQ ID NO: 15691 - protein, 12 aa, Homo sapiens
RITEKLEKQQKI

SEQ ID NO: 15692 - protein, 12 aa, Homo sapiens
RITEKLEKQQKI

SEQ ID NO: 15693 - protein, 12 aa, Homo sapiens
RITEKLEKQQKI

SEQ ID NO: 15694 - protein, 7 aa, Homo sapiens
KKTLAKS

SEQ ID NO: 15695 - protein, 13 aa, Homo sapiens
RTKATIELKALRL

SEQ ID NO: 15696 - protein, 13 aa, Homo sapiens
RTKATIELKALRL

SEQ ID NO: 15697 - protein, 9 aa, Homo sapiens
KKVQEAARA

SEQ ID NO: 15698 - protein, 10 aa, Homo sapiens
RITPIQKPRG

SEQ ID NO: 15699 - protein, 13 aa, Homo sapiens
RAQIMAYKMLARG

SEQ ID NO: 15700 - protein, 13 aa, Homo sapiens
RAQIMAYKMLARG

SEQ ID NO: 15701 - protein, 10 aa, Homo sapiens
RITPIQKPRG

SEQ ID NO: 15702 - protein, 8 aa, Homo sapiens
REQKAKRN

SEQ ID NO: 15703 - protein, 8 aa, Homo sapiens
KIQKLTKA

SEQ ID NO: 15704 - protein, 8 aa, Homo sapiens
KIQKLTKA

SEQ ID NO: 15705 - protein, 8 aa, Homo sapiens
KIQKLTKA

SEQ ID NO: 15706 - protein, 9 aa, Homo sapiens
RAKDDIKKV

SEQ ID NO: 15707 - protein, 8 aa, Homo sapiens
REQKAKRN

SEQ ID NO: 15708 - protein, 8 aa, Homo sapiens
KIQKLSKA

SEQ ID NO: 15709 - protein, 18 aa, Homo sapiens
TPPSMRLKLIANNTTVER

SEQ ID NO: 15710 - protein, 9 aa, Homo sapiens
EGSPANWKR

SEQ ID NO: 15711 - protein, 9 aa, Homo sapiens
EGSPANWKR

SEQ ID NO: 15712 - protein, 8 aa, Homo sapiens
EKLPQVTR

SEQ ID NO: 15713 - protein, 9 aa, Homo sapiens
IKIIAPPER

SEQ ID NO: 15714 - protein, 9 aa, Homo sapiens
IKIIAPPER

SEQ ID NO: 15715 - protein, 5 aa, Homo sapiens
KENER

SEQ ID NO: 15716 - protein, 9 aa, Homo sapiens
IKIIAPPER

SEQ ID NO: 15717 - protein, 12 aa, Homo sapiens
KTDVAECGPGGS

SEQ ID NO: 15718 - protein, 8 aa, Homo sapiens
EDVEKAKK

SEQ ID NO: 15719 - protein, 8 aa, Homo sapiens
QQKIEQER

SEQ ID NO: 15720 - protein, 4 aa, Homo sapiens
KNIR

SEQ ID NO: 15721 - protein, 17 aa, Homo sapiens
NLVFRDFTDEKEGPITK

SEQ ID NO: 15722 - protein, 17 aa, Homo sapiens
NLVFRDFTDEKEGPITK

SEQ ID NO: 15723 - protein, 6 aa, Homo sapiens
MQVLKR

SEQ ID NO: 15724 - protein, 4 aa, Homo sapiens
AVRK

SEQ ID NO: 15725 - protein, 5 aa, Homo sapiens
HQEKK

SEQ ID NO: 15726 - protein, 14 aa, Homo sapiens
LLEDSALSKYDATK

SEQ ID NO: 15727 - protein, 14 aa, Homo sapiens
LLEDSALSKYDATK

SEQ ID NO: 15728 - protein, 14 aa, Homo sapiens
LLEDSALSKYDATK

SEQ ID NO: 15729 - protein, 12 aa, Homo sapiens
GKGEITPAAIQK

SEQ ID NO: 15730 - protein, 12 aa, Homo sapiens
GKGEITPAAIQK

SEQ ID NO: 15731 - protein, 12 aa, Homo sapiens
LKLIANNTTVER

SEQ ID NO: 15732 - protein, 10 aa, Homo sapiens
AAKALLAMAR

SEQ ID NO: 15733 - protein, 10 aa, Homo sapiens
AAKALLAMAR

SEQ ID NO: 15734 - protein, 11 aa, Homo sapiens
ELSQKTPPSMR

SEQ ID NO: 15735 - protein, 18 aa, Homo sapiens
GVACSKDEWWWDCLEVLR

SEQ ID NO: 15736 - protein, 7 aa, Homo sapiens
KASANAR

SEQ ID NO: 15737 - protein, 7 aa, Homo sapiens
KASANAR

SEQ ID NO: 15738 - protein, 11 aa, Homo sapiens
ELSQKTPPSMR

SEQ ID NO: 15739 - protein, 11 aa, Homo sapiens
ELSQKTPPSMR

SEQ ID NO: 15740 - protein, 11 aa, Homo sapiens
ELSQKTPPSMR

SEQ ID NO: 15741 - protein, 13 aa, Homo sapiens
QEYEEGGKQCVER

SEQ ID NO: 15742 - protein, 13 aa, Homo sapiens
QEYEEGGKQCVER

SEQ ID NO: 15743 - protein, 10 aa, Homo sapiens
VSYKGSPAAR

SEQ ID NO: 15744 - protein, 10 aa, Homo sapiens
VSYKGSPAAR

SEQ ID NO: 15745 - protein, 12 aa, Homo sapiens
LKLIANNTTVER

SEQ ID NO: 15746 - protein, 11 aa, Homo sapiens
ELSQKTPPSMR

SEQ ID NO: 15747 - protein, 10 aa, Homo sapiens
THKLQDPHER

SEQ ID NO: 15748 - protein, 7 aa, Homo sapiens
DFKEYHR

SEQ ID NO: 15749 - protein, 7 aa, Homo sapiens
DFKEYHR

SEQ ID NO: 15750 - protein, 6 aa, Homo sapiens
MQVLKR

SEQ ID NO: 15751 - protein, 6 aa, Homo sapiens
MQVLKR

SEQ ID NO: 15752 - protein, 6 aa, Homo sapiens
MQVLKR

SEQ ID NO: 15753 - protein, 6 aa, Homo sapiens
MQVLKR

SEQ ID NO: 15754 - protein, 6 aa, Homo sapiens
MQVLKR

SEQ ID NO: 15755 - protein, 6 aa, Homo sapiens
MQVLKR

SEQ ID NO: 15756 - protein, 6 aa, Homo sapiens
MQVLKR

SEQ ID NO: 15757 - protein, 6 aa, Homo sapiens
MQVLKR

SEQ ID NO: 15758 - protein, 6 aa, Homo sapiens
MQVLKR

SEQ ID NO: 15759 - protein, 6 aa, Homo sapiens
KNVPSK

SEQ ID NO: 15760 - protein, 6 aa, Homo sapiens
KNVPSK

SEQ ID NO: 15761 - protein, 6 aa, Homo sapiens
KTKVER

SEQ ID NO: 15762 - protein, 12 aa, Homo sapiens
EKPTDMQNFGLR

SEQ ID NO: 15763 - protein, 5 aa, Homo sapiens
TKVER

SEQ ID NO: 15764 - protein, 7 aa, Homo sapiens
TDIYSKK

SEQ ID NO: 15765 - protein, 7 aa, Homo sapiens
TDIYSKK

SEQ ID NO: 15766 - protein, 15 aa, Homo sapiens
KFLESTDSFNNELKR

SEQ ID NO: 15767 - protein, 13 aa, Homo sapiens
NKSKTPEIYLAYR

SEQ ID NO: 15768 - protein, 16 aa, Homo sapiens
KDGFTSESTTLEALLR

SEQ ID NO: 15769 - protein, 16 aa, Homo sapiens
KDGFTSESTTLEALLR

SEQ ID NO: 15770 - protein, 14 aa, Homo sapiens
NKEKPVDLQNFGLR

SEQ ID NO: 15771 - protein, 18 aa, Homo sapiens
SLENRMSPSKSPFLPSMK

SEQ ID NO: 15772 - protein, 10 aa, Homo sapiens
AAKALLAMAR

SEQ ID NO: 15773 - protein, 9 aa, Homo sapiens
KLDQTIMRK

SEQ ID NO: 15774 - protein, 8 aa, Homo sapiens
KLDQTIMR

SEQ ID NO: 15775 - protein, 9 aa, Homo sapiens
KLDQTIMRK

SEQ ID NO: 15776 - protein, 8 aa, Homo sapiens
KLDQTIMR

SEQ ID NO: 15777 - protein, 8 aa, Homo sapiens
KLDQTIMR

SEQ ID NO: 15778 - protein, 5 aa, Homo sapiens
KMADK

SEQ ID NO: 15779 - protein, 8 aa, Homo sapiens
KLDQTIAR

SEQ ID NO: 15780 - protein, 8 aa, Homo sapiens
KLDQTIAR

SEQ ID NO: 15781 - protein, 8 aa, Homo sapiens
KLDQTIAR

SEQ ID NO: 15782 - protein, 8 aa, Homo sapiens
KLDQTIAR

SEQ ID NO: 15783 - protein, 8 aa, Homo sapiens
KLDQTIAR

SEQ ID NO: 15784 - protein, 11 aa, Homo sapiens
YVGDRKNPVCR

SEQ ID NO: 15785 - protein, 17 aa, Homo sapiens
DLKIITDVIGNPEEERR

SEQ ID NO: 15786 - protein, 17 aa, Homo sapiens
DLKIITDVIGNPEEERR

SEQ ID NO: 15787 - protein, 16 aa, Homo sapiens
DLKIITDVIGNPEEER

SEQ ID NO: 15788 - protein, 17 aa, Homo sapiens
DLKIITDVIGNPEEERR

SEQ ID NO: 15789 - protein, 17 aa, Homo sapiens
DLKIITDVIGNPEEERR

SEQ ID NO: 15790 - protein, 17 aa, Homo sapiens
DLKIITDVIGNPEEERR

SEQ ID NO: 15791 - protein, 16 aa, Homo sapiens
DLKIITDVIGNPEEER

SEQ ID NO: 15792 - protein, 6 aa, Homo sapiens
NHNAKK

SEQ ID NO: 15793 - protein, 10 aa, Homo sapiens
AAKALLAMAR

SEQ ID NO: 15794 - protein, 13 aa, Homo sapiens
LTMKDIGTPEAWR

SEQ ID NO: 15795 - protein, 13 aa, Homo sapiens
LTMKDIGTPEAWR

SEQ ID NO: 15796 - protein, 7 aa, Homo sapiens
KVQEAAR

SEQ ID NO: 15797 - protein, 7 aa, Homo sapiens
KVQEAAR

SEQ ID NO: 15798 - protein, 10 aa, Homo sapiens
AKHLAAVEER

SEQ ID NO: 15799 - protein, 15 aa, Homo sapiens
VASAAAKAALEEFSR

SEQ ID NO: 15800 - protein, 7 aa, Homo sapiens
TDIYSKK

SEQ ID NO: 15801 - protein, 9 aa, Homo sapiens
EKEALEQQR

SEQ ID NO: 15802 - protein, 8 aa, Homo sapiens
KLDQTIAR

SEQ ID NO: 15803 - protein, 8 aa, Homo sapiens
KLDQTIAR

SEQ ID NO: 15804 - protein, 8 aa, Homo sapiens
KLDQTIAR

SEQ ID NO: 15805 - protein, 8 aa, Homo sapiens
KLDQTIAR

SEQ ID NO: 15806 - protein, 8 aa, Homo sapiens
KLDQTIAR

SEQ ID NO: 15807 - protein, 8 aa, Homo sapiens
KLDQTIAR

SEQ ID NO: 15808 - protein, 8 aa, Homo sapiens
KLDQTIAR

SEQ ID NO: 15809 - protein, 8 aa, Homo sapiens
KLDQTIAR

SEQ ID NO: 15810 - protein, 8 aa, Homo sapiens
KLDQTIAR

SEQ ID NO: 15811 - protein, 8 aa, Homo sapiens
KLDQTIAR

SEQ ID NO: 15812 - protein, 6 aa, Homo sapiens
KNPVCR

SEQ ID NO: 15813 - protein, 6 aa, Homo sapiens
KNPVCR

SEQ ID NO: 15814 - protein, 6 aa, Homo sapiens
KNPVCR

SEQ ID NO: 15815 - protein, 6 aa, Homo sapiens
KNPVCR

SEQ ID NO: 15816 - protein, 11 aa, Homo sapiens
FLSDRKNPVCR

SEQ ID NO: 15817 - protein, 6 aa, Homo sapiens
KNPVCR

SEQ ID NO: 15818 - protein, 6 aa, Homo sapiens
KNPVCR

SEQ ID NO: 15819 - protein, 6 aa, Homo sapiens
KNPVCR

SEQ ID NO: 15820 - protein, 11 aa, Homo sapiens
FLSDRKNPVCR

SEQ ID NO: 15821 - protein, 6 aa, Homo sapiens
KNPVCR

SEQ ID NO: 15822 - protein, 9 aa, Homo sapiens
MADKVLPQR

SEQ ID NO: 15823 - protein, 27 aa, Homo sapiens
KHVTTAEGTPGTTDQEGPPPDGPPEKR

SEQ ID NO: 15824 - protein, 12 aa, Homo sapiens
GKGEITPAAIQK

SEQ ID NO: 15825 - protein, 12 aa, Homo sapiens
GKGEITPAAIQK

SEQ ID NO: 15826 - protein, 9 aa, Homo sapiens
KLDQTIMRK

SEQ ID NO: 15827 - protein, 8 aa, Homo sapiens
KLDQTIMR

SEQ ID NO: 15828 - protein, 8 aa, Homo sapiens
KLDQTIMR

SEQ ID NO: 15829 - protein, 8 aa, Homo sapiens
KLDQTIMR

SEQ ID NO: 15830 - protein, 9 aa, Homo sapiens
KLDQTIMRK

SEQ ID NO: 15831 - protein, 8 aa, Homo sapiens
KLDQTIMR

SEQ ID NO: 15832 - protein, 8 aa, Homo sapiens
KLDQTIMR

SEQ ID NO: 15833 - protein, 5 aa, Homo sapiens
KMADK

SEQ ID NO: 15834 - protein, 5 aa, Homo sapiens
KMADK

SEQ ID NO: 15835 - protein, 6 aa, Homo sapiens
KNPVCR

SEQ ID NO: 15836 - protein, 6 aa, Homo sapiens
KNPVCR

SEQ ID NO: 15837 - protein, 6 aa, Homo sapiens
KNPVCR

SEQ ID NO: 15838 - protein, 8 aa, Homo sapiens
KLDQTIMR

SEQ ID NO: 15839 - protein, 8 aa, Homo sapiens
KLDQTIMR

SEQ ID NO: 15840 - protein, 8 aa, Homo sapiens
KLDQTIMR

SEQ ID NO: 15841 - protein, 14 aa, Homo sapiens
KYSDSSLPPSNSGK

SEQ ID NO: 15842 - protein, 14 aa, Homo sapiens
KYSDSSLPPSNSGK

SEQ ID NO: 15843 - protein, 14 aa, Homo sapiens
KYSDSSLPPSNSGK

SEQ ID NO: 15844 - protein, 14 aa, Homo sapiens
KYSDSSLPPSNSGK

SEQ ID NO: 15845 - protein, 15 aa, Homo sapiens
DTALETALNAKAYKR

SEQ ID NO: 15846 - protein, 7 aa, Homo sapiens
KVEEAAK

SEQ ID NO: 15847 - protein, 7 aa, Homo sapiens
KVEEAAK

SEQ ID NO: 15848 - protein, 7 aa, Homo sapiens
KVEEAAK

SEQ ID NO: 15849 - protein, 15 aa, Homo sapiens
VASAAAKSALEEFSK

SEQ ID NO: 15850 - protein, 15 aa, Homo sapiens
VASAAAKSALEEFSK

SEQ ID NO: 15851 - protein, 7 aa, Homo sapiens
TDMYTKK

SEQ ID NO: 15852 - protein, 7 aa, Homo sapiens
TDMYTKK

SEQ ID NO: 15853 - protein, 7 aa, Homo sapiens
TDMYTKK

SEQ ID NO: 15854 - protein, 19 aa, Homo sapiens
KRPAPQQIQQVQQQAVQNR

SEQ ID NO: 15855 - protein, 19 aa, Homo sapiens
KRPAPQQIQQVQQQAVQNR

SEQ ID NO: 15856 - protein, 19 aa, Homo sapiens
KRPAPQQIQQVQQQAVQNR

SEQ ID NO: 15857 - protein, 14 aa, Homo sapiens
MSYEPNKDPYGSMR

SEQ ID NO: 15858 - protein, 14 aa, Homo sapiens
MSYEPNKDPYGSMR

SEQ ID NO: 15859 - protein, 6 aa, Homo sapiens
NHNAKK

SEQ ID NO: 15860 - protein, 6 aa, Homo sapiens
KNPVCR

SEQ ID NO: 15861 - protein, 6 aa, Homo sapiens
KNPVCR

SEQ ID NO: 15862 - protein, 5 aa, Homo sapiens
KVDAR

SEQ ID NO: 15863 - protein, 5 aa, Homo sapiens
KVDAR

SEQ ID NO: 15864 - protein, 10 aa, Homo sapiens
ITEKLEKQQK

SEQ ID NO: 15865 - protein, 10 aa, Homo sapiens
ITEKLEKQQK

SEQ ID NO: 15866 - protein, 10 aa, Homo sapiens
ITEKLEKQQK

SEQ ID NO: 15867 - protein, 5 aa, Homo sapiens
KTLAK

SEQ ID NO: 15868 - protein, 11 aa, Homo sapiens
TKATIELKALR

SEQ ID NO: 15869 - protein, 11 aa, Homo sapiens
TKATIELKALR

SEQ ID NO: 15870 - protein, 7 aa, Homo sapiens
KVQEAAR

SEQ ID NO: 15871 - protein, 8 aa, Homo sapiens
ITPIQKPR

SEQ ID NO: 15872 - protein, 11 aa, Homo sapiens
AQIMAYKMLAR

SEQ ID NO: 15873 - protein, 11 aa, Homo sapiens
AQIMAYKMLAR

SEQ ID NO: 15874 - protein, 8 aa, Homo sapiens
ITPIQKPR

SEQ ID NO: 15875 - protein, 6 aa, Homo sapiens
EQKAKR

SEQ ID NO: 15876 - protein, 6 aa, Homo sapiens
IQKLTK

SEQ ID NO: 15877 - protein, 6 aa, Homo sapiens
IQKLTK

SEQ ID NO: 15878 - protein, 6 aa, Homo sapiens
IQKLTK

SEQ ID NO: 15879 - protein, 7 aa, Homo sapiens
AKDDIKK

SEQ ID NO: 15880 - protein, 6 aa, Homo sapiens
EQKAKR

SEQ ID NO: 15881 - protein, 6 aa, Homo sapiens
IQKLSK

SEQ ID NO: 15882 - protein, 13 aa, Homo sapiens
RKVEEAAKVTGKA

SEQ ID NO: 15883 - protein, 9 aa, Homo sapiens
RTDMYTKKN

SEQ ID NO: 15884 - protein, 11 aa, Homo sapiens
KSKAAASATRE

SEQ ID NO: 15885 - protein, 11 aa, Homo sapiens
KSKAAASATRE

SEQ ID NO: 15886 - protein, 11 aa, Homo sapiens
KSKAAASATRE

SEQ ID NO: 15887 - protein, 12 aa, Homo sapiens
KAKHLAAVEERK

SEQ ID NO: 15888 - protein, 17 aa, Homo sapiens
KMKEEVPTALVEAHVRK

SEQ ID NO: 15889 - protein, 9 aa, Homo sapiens
RKVEEAAKV

SEQ ID NO: 15890 - protein, 17 aa, Homo sapiens
KMKEEVPTALVEAHVRK

SEQ ID NO: 15891 - protein, 25 aa, Homo sapiens
KSALEEFSKMKEEVPTALVEAHVRK

SEQ ID NO: 15892 - protein, 9 aa, Homo sapiens
RKVEEAAKV

SEQ ID NO: 15893 - protein, 17 aa, Homo sapiens
KMKEEVPTALVEAHVRK

SEQ ID NO: 15894 - protein, 17 aa, Homo sapiens
KMKEEVPTALVEAHVRK

SEQ ID NO: 15895 - protein, 14 aa, Homo sapiens
RRALPEFFNGKNKS

SEQ ID NO: 15896 - protein, 13 aa, Homo sapiens
KSKTPEIYLAYRN

SEQ ID NO: 15897 - protein, 11 aa, Homo sapiens
KSKAAASATRE

SEQ ID NO: 15898 - protein, 16 aa, Homo sapiens
KTVNTKKDSESAPVKG

SEQ ID NO: 15899 - protein, 32 aa, Homo sapiens; identical to SEQ ID NO: 5995

SEQ ID NO: 15900 - protein, 32 aa, Homo sapiens; identical to SEQ ID NO: 5995

SEQ ID NO: 15901 - protein, 32 aa, Homo sapiens; identical to SEQ ID NO: 5995

SEQ ID NO: 15902 - protein, 32 aa, Homo sapiens; identical to SEQ ID NO: 5995

SEQ ID NO: 15903 - protein, 16 aa, Homo sapiens
KTVNTKKDSESAPVKG

SEQ ID NO: 15904 - protein, 32 aa, Homo sapiens; identical to SEQ ID NO: 5995

SEQ ID NO: 15905 - protein, 32 aa, Homo sapiens; identical to SEQ ID NO: 5995

SEQ ID NO: 15906 - protein, 32 aa, Homo sapiens; identical to SEQ ID NO: 5995

SEQ ID NO: 15907 - protein, 13 aa, Homo sapiens
RKVEEAAKVTGKA

SEQ ID NO: 15908 - protein, 13 aa, Homo sapiens
RKVEEAAKVTGKA

SEQ ID NO: 15909 - protein, 13 aa, Homo sapiens
RKVEEAAKVTGKA

SEQ ID NO: 15910 - protein, 8 aa, Homo sapiens
RKTKVERD

SEQ ID NO: 15911 - protein, 13 aa, Homo sapiens
RKVEEAAKVTGKA

SEQ ID NO: 15912 - protein, 28 aa, Homo sapiens
KSLVQNNCLSRPNIFLCPEIEPKLLGKL

SEQ ID NO: 15913 - protein, 17 aa, Homo sapiens
RVASAAAKSALEEFSKM

SEQ ID NO: 15914 - protein, 17 aa, Homo sapiens
RVASAAAKSALEEFSKM

SEQ ID NO: 15915 - protein, 25 aa, Homo sapiens
KSALEEFSKMKEEVPTALVEAHVRK

SEQ ID NO: 15916 - protein, 17 aa, Homo sapiens
RVASAAAKSALEEFSKM

SEQ ID NO: 15917 - protein, 17 aa, Homo sapiens
RVASAAAKSALEEFSKM

SEQ ID NO: 15918 - protein, 7 aa, Homo sapiens
KTKVERD

SEQ ID NO: 15919 - protein, 7 aa, Homo sapiens
KTKVERD

SEQ ID NO: 15920 - protein, 25 aa, Homo sapiens
KDMDEPSPVPNVEEVTLPKTVNTKK

SEQ ID NO: 15921 - protein, 38 aa, Homo sapiens; identical to SEQ ID NO: 6132

SEQ ID NO: 15922 - protein, 9 aa, Homo sapiens
RKVEEAAKV

SEQ ID NO: 15923 - protein, 9 aa, Homo sapiens
RKVEEAAKV

SEQ ID NO: 15924 - protein, 12 aa, Homo sapiens
KAKHLAAVEERK

SEQ ID NO: 15925 - protein, 16 aa, Homo sapiens
KGKEKPTDMQNFGLRT

SEQ ID NO: 15926 - protein, 16 aa, Homo sapiens
KGKEKPTDMQNFGLRT

SEQ ID NO: 15927 - protein, 20 aa, Homo sapiens
KISAKTLTDEVNSPDSDRRD

SEQ ID NO: 15928 - protein, 20 aa, Homo sapiens
KISAKTLTDEVNSPDSDRRD

SEQ ID NO: 15929 - protein, 13 aa, Homo sapiens
KAKHLAAVEERKI

SEQ ID NO: 15930 - protein, 20 aa, Homo sapiens
KEGQEEVLKEVVESEGERKT

SEQ ID NO: 15931 - protein, 28 aa, Homo sapiens
KTKVERDIGEGNLSTAAAAALAAAAVKA

SEQ ID NO: 15932 - protein, 8 aa, Homo sapiens
RKTKVERD

SEQ ID NO: 15933 - protein, 8 aa, Homo sapiens
RKTKVERD

SEQ ID NO: 15934 - protein, 19 aa, Homo sapiens
KEGQEEVLKEVVESEGERK

SEQ ID NO: 15935 - protein, 19 aa, Homo sapiens
KEGQEEVLKEVVESEGERK

SEQ ID NO: 15936 - protein, 18 aa, Homo sapiens
KAGGSLCHILAAAYKFKS

SEQ ID NO: 15937 - protein, 21 aa, Homo sapiens
KTPQQTSASQQMLNFPDKGKE

SEQ ID NO: 15938 - protein, 14 aa, Homo sapiens
KEKPTDMQNFGLRT

SEQ ID NO: 15939 - protein, 21 aa, Homo sapiens
KTPQQTSASQQMLNFPDKGKE

SEQ ID NO: 15940 - protein, 21 aa, Homo sapiens
KTPQQTSASQQMLNFPDKGKE

SEQ ID NO: 15941 - protein, 14 aa, Homo sapiens
KEKPTDMQNFGLRT

SEQ ID NO: 15942 - protein, 14 aa, Homo sapiens
KEKPTDMQNFGLRT

SEQ ID NO: 15943 - protein, 14 aa, Homo sapiens
KEKPTDMQNFGLRT

SEQ ID NO: 15944 - protein, 14 aa, Homo sapiens
KEKPTDMQNFGLRT

SEQ ID NO: 15945 - protein, 14 aa, Homo sapiens
KEKPTDMQNFGLRT

SEQ ID NO: 15946 - protein, 14 aa, Homo sapiens
KEKPTDMQNFGLRT

SEQ ID NO: 15947 - protein, 21 aa, Homo sapiens
KTPQQTSASQQMLNFPDKGKE

SEQ ID NO: 15948 - protein, 11 aa, Homo sapiens
KSKAAASATRE

SEQ ID NO: 15949 - protein, 11 aa, Homo sapiens
KSKAAASATRE

SEQ ID NO: 15950 - protein, 11 aa, Homo sapiens
KSKAAASATRE

SEQ ID NO: 15951 - protein, 21 aa, Homo sapiens
RKRPAPQQIQQVQQQAVQNRN

SEQ ID NO: 15952 - protein, 18 aa, Homo sapiens
RDLKTMTDVVGNPEEERR

SEQ ID NO: 15953 - protein, 29 aa, Homo sapiens
RIFISNTFNPAKSDAEDGEGTVASWELRV

SEQ ID NO: 15954 - protein, 33 aa, Homo sapiens; identical to SEQ ID NO: 6261

SEQ ID NO: 15955 - protein, 29 aa, Homo sapiens
RIFISNTFNPAKSDAEDGEGTVASWELRV

SEQ ID NO: 15956 - protein, 33 aa, Homo sapiens; identical to SEQ ID NO: 6261

SEQ ID NO: 15957 - protein, 29 aa, Homo sapiens
RIFISNTFNPAKSDAEDGEGTVASWELRV

SEQ ID NO: 15958 - protein, 29 aa, Homo sapiens
RIFISNTFNPAKSDAEDGEGTVASWELRV

SEQ ID NO: 15959 - protein, 33 aa, Homo sapiens; identical to SEQ ID NO: 6261

SEQ ID NO: 15960 - protein, 29 aa, Homo sapiens
RIFISNTFNPAKSDAEDGEGTVASWELRV

SEQ ID NO: 15961 - protein, 29 aa, Homo sapiens
RIFISNTFNPAKSDAEDGEGTVASWELRV

SEQ ID NO: 15962 - protein, 33 aa, Homo sapiens; identical to SEQ ID NO: 6261

SEQ ID NO: 15963 - protein, 29 aa, Homo sapiens
RIFISNTFNPAKSDAEDGEGTVASWELRV

SEQ ID NO: 15964 - protein, 33 aa, Homo sapiens; identical to SEQ ID NO: 6261

SEQ ID NO: 15965 - protein, 33 aa, Homo sapiens; identical to SEQ ID NO: 6261

SEQ ID NO: 15966 - protein, 29 aa, Homo sapiens
RIFISNTFNPAKSDAEDGEGTVASWELRV

SEQ ID NO: 15967 - protein, 29 aa, Homo sapiens
RIFISNTFNPAKSDAEDGEGTVASWELRV

SEQ ID NO: 15968 - protein, 29 aa, Homo sapiens
RIFISNTFNPAKSDAEDGEGTVASWELRV

SEQ ID NO: 15969 - protein, 33 aa, Homo sapiens; identical to SEQ ID NO: 6261

SEQ ID NO: 15970 - protein, 33 aa, Homo sapiens; identical to SEQ ID NO: 6261

SEQ ID NO: 15971 - protein, 33 aa, Homo sapiens; identical to SEQ ID NO: 6261

SEQ ID NO: 15972 - protein, 29 aa, Homo sapiens
RIFISNTFNPAKSDAEDGEGTVASWELRV

SEQ ID NO: 15973 - protein, 28 aa, Homo sapiens
RLHALLMPPEPIIINHVISVDPNDQKKT

SEQ ID NO: 15974 - protein, 11 aa, Homo sapiens
RLDIQEALKRP

SEQ ID NO: 15975 - protein, 11 aa, Homo sapiens
RLDIQEALKRP

SEQ ID NO: 15976 - protein, 11 aa, Homo sapiens
RLDIQEALKRP

SEQ ID NO: 15977 - protein, 11 aa, Homo sapiens
RMKFSEIPQRL

SEQ ID NO: 15978 - protein, 7 aa, Homo sapiens
RKKSGKK

SEQ ID NO: 15979 - protein, 7 aa, Homo sapiens
RKKSGKK

SEQ ID NO: 15980 - protein, 33 aa, Homo sapiens
RSQKEEDEQEDLTKDMEDPTPVPNIEEVVLPKN

SEQ ID NO: 15981 - protein, 33 aa, Homo sapiens; identical to SEQ ID NO: 15980

SEQ ID NO: 15982 - protein, 33 aa, Homo sapiens; identical to SEQ ID NO: 15980

SEQ ID NO: 15983 - protein, 16 aa, Homo sapiens
RISTKNEEPVRSPERR

SEQ ID NO: 15984 - protein, 16 aa, Homo sapiens
RISTKNEEPVRSPERR

SEQ ID NO: 15985 - protein, 16 aa, Homo sapiens
RISTKNEEPVRSPERR

SEQ ID NO: 15986 - protein, 7 aa, Homo sapiens
RKKSGKK

SEQ ID NO: 15987 - protein, 11 aa, Homo sapiens
KKGQASLYGKR

SEQ ID NO: 15988 - protein, 11 aa, Homo sapiens
RDRKASANARK

SEQ ID NO: 15989 - protein, 10 aa, Homo sapiens
RKDGGPATKF

SEQ ID NO: 15990 - protein, 9 aa, Homo sapiens
KKVQEAARA

SEQ ID NO: 15991 - protein, 9 aa, Homo sapiens
KKVQEAARA

SEQ ID NO: 15992 - protein, 9 aa, Homo sapiens
KKVQEAARA

SEQ ID NO: 15993 - protein, 11 aa, Homo sapiens
RDRKASANARK

SEQ ID NO: 15994 - protein, 33 aa, Homo sapiens; identical to SEQ ID NO: 15980

SEQ ID NO: 15995 - protein, 11 aa, Homo sapiens
KGQASLYGKRR

SEQ ID NO: 15996 - protein, 12 aa, Homo sapiens
KGQASLYGKRRS

SEQ ID NO: 15997 - protein, 12 aa, Homo sapiens
KGQASLYGKRRS

SEQ ID NO: 15998 - protein, 24 aa, Homo sapiens
KDGGPATKFWESPETVSQLDSVRV

SEQ ID NO: 15999 - protein, 27 aa, Homo sapiens
KKVEHEISEGNVATAAAAALASAATKA

SEQ ID NO: 16000 - protein, 27 aa, Homo sapiens
KKVEHEISEGNVATAAAAALASAATKA

SEQ ID NO: 16001 - protein, 27 aa, Homo sapiens
KKVEHEISEGNVATAAAAALASAATKA

SEQ ID NO: 16002 - protein, 27 aa, Homo sapiens
KKVEHEISEGNVATAAAAALASAATKA

SEQ ID NO: 16003 - protein, 27 aa, Homo sapiens
KKVEHEISEGNVATAAAAALASAATKA

SEQ ID NO: 16004 - protein, 27 aa, Homo sapiens
KKVEHEISEGNVATAAAAALASAATKA

SEQ ID NO: 16005 - protein, 18 aa, Homo sapiens
RVREEVPLELVEAHVKKV

SEQ ID NO: 16006 - protein, 34 aa, Homo sapiens
KGGTVADLDEQDEETVTAGGKEDEDPAKGDQSRS

SEQ ID NO: 16007 - protein, 34 aa, Homo sapiens; identical to SEQ ID NO: 16006

SEQ ID NO: 16008 - protein, 17 aa, Homo sapiens
RVASAAAKAALEEFSRV

SEQ ID NO: 16009 - protein, 17 aa, Homo sapiens
RVASAAAKAALEEFSRV

SEQ ID NO: 16010 - protein, 18 aa, Homo sapiens
RVREEVPLELVEAHVKKV

SEQ ID NO: 16011 - protein, 18 aa, Homo sapiens
RVREEVPLELVEAHVKKV

SEQ ID NO: 16012 - protein, 18 aa, Homo sapiens
RVREEVPLELVEAHVKKV

SEQ ID NO: 16013 - protein, 17 aa, Homo sapiens
RVASAAAKAALEEFSRV

SEQ ID NO: 16014 - protein, 27 aa, Homo sapiens
KKVEHEISEGNVATAAAAALASAATKA

SEQ ID NO: 16015 - protein, 27 aa, Homo sapiens
KKVEHEISEGNVATAAAAALASAATKA

SEQ ID NO: 16016 - protein, 30 aa, Homo sapiens; identical to SEQ ID NO: 6536

SEQ ID NO: 16017 - protein, 13 aa, Homo sapiens
RHQGTFTDEKSKA

SEQ ID NO: 16018 - protein, 13 aa, Homo sapiens
RHQGTFTDEKSKA

SEQ ID NO: 16019 - protein, 13 aa, Homo sapiens
RHQGTFTDEKSKA

SEQ ID NO: 16020 - protein, 20 aa, Homo sapiens
KEKPVDLQNFGLRTDIYSKK

SEQ ID NO: 16021 - protein, 20 aa, Homo sapiens
RSPQVPAAQQMLNFPEKNKE

SEQ ID NO: 16022 - protein, 20 aa, Homo sapiens
RSPQVPAAQQMLNFPEKNKE

SEQ ID NO: 16023 - protein, 20 aa, Homo sapiens
RSPQVPAAQQMLNFPEKNKE

SEQ ID NO: 16024 - protein, 20 aa, Homo sapiens
KEKPVDLQNFGLRTDIYSKK

SEQ ID NO: 16025 - protein, 20 aa, Homo sapiens
RSPQVPAAQQMLNFPEKNKE

SEQ ID NO: 16026 - protein, 14 aa, Homo sapiens
KEKPVDLQNFGLRT

SEQ ID NO: 16027 - protein, 20 aa, Homo sapiens
RSPQVPAAQQMLNFPEKNKE

SEQ ID NO: 16028 - protein, 20 aa, Homo sapiens
KEKPVDLQNFGLRTDIYSKK

SEQ ID NO: 16029 - protein, 14 aa, Homo sapiens
KEKPVDLQNFGLRT

SEQ ID NO: 16030 - protein, 20 aa, Homo sapiens
RSPQVPAAQQMLNFPEKNKE

SEQ ID NO: 16031 - protein, 20 aa, Homo sapiens
RSPQVPAAQQMLNFPEKNKE

SEQ ID NO: 16032 - protein, 14 aa, Homo sapiens
KEKPVDLQNFGLRT

SEQ ID NO: 16033 - protein, 14 aa, Homo sapiens
KEKPVDLQNFGLRT

SEQ ID NO: 16034 - protein, 14 aa, Homo sapiens
KEKPVDLQNFGLRT

SEQ ID NO: 16035 - protein, 14 aa, Homo sapiens
KEKPVDLQNFGLRT

SEQ ID NO: 16036 - protein, 14 aa, Homo sapiens
KEKPVDLQNFGLRT

SEQ ID NO: 16037 - protein, 14 aa, Homo sapiens
KEKPVDLQNFGLRT

SEQ ID NO: 16038 - protein, 14 aa, Homo sapiens
KEKPVDLQNFGLRT

SEQ ID NO: 16039 - protein, 14 aa, Homo sapiens
KEKPVDLQNFGLRT

SEQ ID NO: 16040 - protein, 20 aa, Homo sapiens
RSPQVPAAQQMLNFPEKNKE

SEQ ID NO: 16041 - protein, 14 aa, Homo sapiens
KEKPVDLQNFGLRT

SEQ ID NO: 16042 - protein, 14 aa, Homo sapiens
KEKPVDLQNFGLRT

SEQ ID NO: 16043 - protein, 14 aa, Homo sapiens
KEKPVDLQNFGLRT

SEQ ID NO: 16044 - protein, 14 aa, Homo sapiens
KEKPVDLQNFGLRT

SEQ ID NO: 16045 - protein, 14 aa, Homo sapiens
KEKPVDLQNFGLRT

SEQ ID NO: 16046 - protein, 14 aa, Homo sapiens
KEKPVDLQNFGLRT

SEQ ID NO: 16047 - protein, 14 aa, Homo sapiens
KEKPVDLQNFGLRT

SEQ ID NO: 16048 - protein, 20 aa, Homo sapiens
KEKPVDLQNFGLRTDIYSKK

SEQ ID NO: 16049 - protein, 14 aa, Homo sapiens
KEKPVDLQNFGLRT

SEQ ID NO: 16050 - protein, 20 aa, Homo sapiens
RSPQVPAAQQMLNFPEKNKE

SEQ ID NO: 16051 - protein, 20 aa, Homo sapiens
RSPQVPAAQQMLNFPEKNKE

SEQ ID NO: 16052 - protein, 14 aa, Homo sapiens
KEKPVDLQNFGLRT

SEQ ID NO: 16053 - protein, 14 aa, Homo sapiens
KEKPVDLQNFGLRT

SEQ ID NO: 16054 - protein, 14 aa, Homo sapiens
KEKPVDLQNFGLRT

SEQ ID NO: 16055 - protein, 14 aa, Homo sapiens
KEKPVDLQNFGLRT

SEQ ID NO: 16056 - protein, 20 aa, Homo sapiens
RSPQVPAAQQMLNFPEKNKE

SEQ ID NO: 16057 - protein, 20 aa, Homo sapiens
RSPQVPAAQQMLNFPEKNKE

SEQ ID NO: 16058 - protein, 20 aa, Homo sapiens
RSPQVPAAQQMLNFPEKNKE

SEQ ID NO: 16059 - protein, 9 aa, Homo sapiens
KKVQEAARA

SEQ ID NO: 16060 - protein, 9 aa, Homo sapiens
KKVQEAARA

SEQ ID NO: 16061 - protein, 27 aa, Homo sapiens
KKVEHEISEGNVATAAAAALASAATKA

SEQ ID NO: 16062 - protein, 16 aa, Homo sapiens
KNVNLKKDSENTPVKG

SEQ ID NO: 16063 - protein, 34 aa, Homo sapiens; identical to SEQ ID NO: 16006

SEQ ID NO: 16064 - protein, 10 aa, Homo sapiens
KSKGASAGRE

SEQ ID NO: 16065 - protein, 9 aa, Homo sapiens
RTDIYSKKT

SEQ ID NO: 16066 - protein, 9 aa, Homo sapiens
RTDIYSKKT

SEQ ID NO: 16067 - protein, 8 aa, Homo sapiens
KTLAKSKG

SEQ ID NO: 16068 - protein, 23 aa, Homo sapiens
RSNSVGIQDAFNDGSDSTFQKRN

SEQ ID NO: 16069 - protein, 23 aa, Homo sapiens
RSNSVGIQDAFNDGSDSTFQKRN

SEQ ID NO: 16070 - protein, 23 aa, Homo sapiens
RSNSVGIQDAFNDGSDSTFQKRN

SEQ ID NO: 16071 - protein, 23 aa, Homo sapiens
RSNSVGIQDAFNDGSDSTFQKRN

SEQ ID NO: 16072 - protein, 23 aa, Homo sapiens
RSNSVGIQDAFNDGSDSTFQKRN

SEQ ID NO: 16073 - protein, 27 aa, Homo sapiens
RKAPGSDPFMSSGQGPNGGMGDPYSRA

SEQ ID NO: 16074 - protein, 27 aa, Homo sapiens
RKAPGSDPFMSSGQGPNGGMGDPYSRA

SEQ ID NO: 16075 - protein, 27 aa, Homo sapiens
RKAPGSDPFMSSGQGPNGGMGDPYSRA

SEQ ID NO: 16076 - protein, 23 aa, Homo sapiens
RSNSVGIQDAFNDGSDSTFQKRN

SEQ ID NO: 16077 - protein, 31 aa, Homo sapiens; identical to SEQ ID NO: 424

SEQ ID NO: 16078 - protein, 31 aa, Homo sapiens; identical to SEQ ID NO: 424

SEQ ID NO: 16079 - protein, 31 aa, Homo sapiens; identical to SEQ ID NO: 424

SEQ ID NO: 16080 - protein, 9 aa, Homo sapiens
KFDKLPVKI

SEQ ID NO: 16081 - protein, 17 aa, Homo sapiens
KDKPASENSEEKLISKF

SEQ ID NO: 16082 - protein, 17 aa, Homo sapiens
KDKPASENSEEKLISKF

SEQ ID NO: 16083 - protein, 17 aa, Homo sapiens
KDKPASENSEEKLISKF

SEQ ID NO: 16084 - protein, 27 aa, Homo sapiens
RKAPGSDPFMSSGQGPNGGMGDPYSRA

SEQ ID NO: 16085 - protein, 27 aa, Homo sapiens
RKAPGSDPFMSSGQGPNGGMGDPYSRA

SEQ ID NO: 16086 - protein, 16 aa, Homo sapiens
RMSYEPNKDPYGSMRK

SEQ ID NO: 16087 - protein, 27 aa, Homo sapiens
RKAPGSDPFMSSGQGPNGGMGDPYSRA

SEQ ID NO: 16088 - protein, 16 aa, Homo sapiens
RMSYEPNKDPYGSMRK

SEQ ID NO: 16089 - protein, 16 aa, Homo sapiens
RMSYEPNKDPYGSMRK

SEQ ID NO: 16090 - protein, 16 aa, Homo sapiens
RMSYEPNKDPYGSMRK

SEQ ID NO: 16091 - protein, 27 aa, Homo sapiens
RKAPGSDPFMSSGQGPNGGMGDPYSRA

SEQ ID NO: 16092 - protein, 27 aa, Homo sapiens
RKAPGSDPFMSSGQGPNGGMGDPYSRA

SEQ ID NO: 16093 - protein, 16 aa, Homo sapiens
RMSYEPNKDPYGSMRK

SEQ ID NO: 16094 - protein, 16 aa, Homo sapiens
RMSYEPNKDPYGSMRK

SEQ ID NO: 16095 - protein, 16 aa, Homo sapiens
RMSYEPNKDPYGSMRK

SEQ ID NO: 16096 - protein, 16 aa, Homo sapiens
RMSYEPNKDPYGSMRK

SEQ ID NO: 16097 - protein, 27 aa, Homo sapiens
RKAPGSDPFMSSGQGPNGGMGDPYSRA

SEQ ID NO: 16098 - protein, 16 aa, Homo sapiens
RMSYEPNKDPYGSMRK

SEQ ID NO: 16099 - protein, 16 aa, Homo sapiens
RMSYEPNKDPYGSMRK

SEQ ID NO: 16100 - protein, 16 aa, Homo sapiens
RMSYEPNKDPYGSMRK

SEQ ID NO: 16101 - protein, 16 aa, Homo sapiens
RMSYEPNKDPYGSMRK

SEQ ID NO: 16102 - protein, 16 aa, Homo sapiens
RMSYEPNKDPYGSMRK

SEQ ID NO: 16103 - protein, 16 aa, Homo sapiens
RMSYEPNKDPYGSMRK

SEQ ID NO: 16104 - protein, 27 aa, Homo sapiens
RKAPGSDPFMSSGQGPNGGMGDPYSRA

SEQ ID NO: 16105 - protein, 16 aa, Homo sapiens
RMSYEPNKDPYGSMRK

SEQ ID NO: 16106 - protein, 18 aa, Homo sapiens
RSSTLTEDGAKSSEAIKE

SEQ ID NO: 16107 - protein, 18 aa, Homo sapiens
RSSTLTEDGAKSSEAIKE

SEQ ID NO: 16108 - protein, 18 aa, Homo sapiens
RSSTLTEDGAKSSEAIKE

SEQ ID NO: 16109 - protein, 18 aa, Homo sapiens
RSSTLTEDGAKSSEAIKE

SEQ ID NO: 16110 - protein, 14 aa, Homo sapiens
KLILLHHKHPERKQ

SEQ ID NO: 16111 - protein, 29 aa, Homo sapiens
RKHVTTAEGTPGTTDQEGPPPDGPPEKRI

SEQ ID NO: 16112 - protein, 16 aa, Homo sapiens
KITKLYELGGEPERKM

SEQ ID NO: 16113 - protein, 15 aa, Homo sapiens
KITKLYELGGEPERK

SEQ ID NO: 16114 - protein, 15 aa, Homo sapiens
KITKLYELGGEPERK

SEQ ID NO: 16115 - protein, 15 aa, Homo sapiens
KITKLYELGGEPERK

SEQ ID NO: 16116 - protein, 16 aa, Homo sapiens
RMSYEPNKDPYGSMRK

SEQ ID NO: 16117 - protein, 13 aa, Homo sapiens
KKSSSSTTTNEKI

SEQ ID NO: 16118 - protein, 23 aa, Homo sapiens
RSNSVGIQDAFNDGSDSTFQKRN

SEQ ID NO: 16119 - protein, 23 aa, Homo sapiens
RSNSVGIQDAFNDGSDSTFQKRN

SEQ ID NO: 16120 - protein, 23 aa, Homo sapiens
RSNSVGIQDAFNDGSDSTFQKRN

SEQ ID NO: 16121 - protein, 26 aa, Homo sapiens
RGEMKAAAGQESEGPAVGPPQPLGKE

SEQ ID NO: 16122 - protein, 12 aa, Homo sapiens
RLEKLYSTMVRF

SEQ ID NO: 16123 - protein, 12 aa, Homo sapiens
RLEKLYSTMVRF

SEQ ID NO: 16124 - protein, 8 aa, Homo sapiens
RKNPVCRE

SEQ ID NO: 16125 - protein, 7 aa, Homo sapiens
KIKLGRK

SEQ ID NO: 16126 - protein, 17 aa, Homo sapiens
KIVDAVIKYKDSSSGRQ

SEQ ID NO: 16127 - protein, 18 aa, Homo sapiens
RKRDSDAGSSTPTTSTRS

SEQ ID NO: 16128 - protein, 18 aa, Homo sapiens
RKRDSDAGSSTPTTSTRS

SEQ ID NO: 16129 - protein, 18 aa, Homo sapiens
RKRDSDAGSSTPTTSTRS

SEQ ID NO: 16130 - protein, 18 aa, Homo sapiens
RKRDSDAGSSTPTTSTRS

SEQ ID NO: 16131 - protein, 18 aa, Homo sapiens
RKRDSDAGSSTPTTSTRS

SEQ ID NO: 16132 - protein, 18 aa, Homo sapiens
RKRDSDAGSSTPTTSTRS

SEQ ID NO: 16133 - protein, 18 aa, Homo sapiens
RKRDSDAGSSTPTTSTRS

SEQ ID NO: 16134 - protein, 18 aa, Homo sapiens
RKRDSDAGSSTPTTSTRS

SEQ ID NO: 16135 - protein, 18 aa, Homo sapiens
RKRDSDAGSSTPTTSTRS

SEQ ID NO: 16136 - protein, 18 aa, Homo sapiens
RKRDSDAGSSTPTTSTRS

SEQ ID NO: 16137 - protein, 18 aa, Homo sapiens
KVIQAGMFDQKSSSHERR

SEQ ID NO: 16138 - protein, 18 aa, Homo sapiens
KVIQAGMFDQKSSSHERR

SEQ ID NO: 16139 - protein, 7 aa, Homo sapiens
RIEKERM

SEQ ID NO: 16140 - protein, 17 aa, Homo sapiens
KAVATYHANTEREQKKE

SEQ ID NO: 16141 - protein, 17 aa, Homo sapiens
KAVATYHANTEREQKKE

SEQ ID NO: 16142 - protein, 17 aa, Homo sapiens
KAVATYHANTEREQKKE

SEQ ID NO: 16143 - protein, 17 aa, Homo sapiens
KAVATYHANTEREQKKE

SEQ ID NO: 16144 - protein, 17 aa, Homo sapiens
KAVATYHANTEREQKKE

SEQ ID NO: 16145 - protein, 17 aa, Homo sapiens
KAVATYHANTEREQKKE

SEQ ID NO: 16146 - protein, 11 aa, Homo sapiens
KENERIEKERM

SEQ ID NO: 16147 - protein, 17 aa, Homo sapiens
KAVATYHANTEREQKKE

SEQ ID NO: 16148 - protein, 17 aa, Homo sapiens
KAVATYHANTEREQKKE

SEQ ID NO: 16149 - protein, 17 aa, Homo sapiens
KAVATYHANTEREQKKE

SEQ ID NO: 16150 - protein, 17 aa, Homo sapiens
KAVATYHANTEREQKKE

SEQ ID NO: 16151 - protein, 8 aa, Homo sapiens
KLIDQKKD

SEQ ID NO: 16152 - protein, 19 aa, Homo sapiens
RGRPPAEKLSPNPPNLTKK

SEQ ID NO: 16153 - protein, 9 aa, Homo sapiens
RKEKAQDRL

SEQ ID NO: 16154 - protein, 17 aa, Homo sapiens
KIVDAVIKYKDSSSGRQ

SEQ ID NO: 16155 - protein, 24 aa, Homo sapiens
RHIIENAKQDVDDEYGVSQALARG

SEQ ID NO: 16156 - protein, 24 aa, Homo sapiens
RHIIENAKQDVDDEYGVSQALARG

SEQ ID NO: 16157 - protein, 6 aa, Homo sapiens
KKDKRL

SEQ ID NO: 16158 - protein, 6 aa, Homo sapiens
KKDKRL

SEQ ID NO: 16159 - protein, 6 aa, Homo sapiens
KKDKRL

SEQ ID NO: 16160 - protein, 18 aa, Homo sapiens
RLMAEDEEGYRKLIDQKK

SEQ ID NO: 16161 - protein, 6 aa, Homo sapiens
KKDKRL

SEQ ID NO: 16162 - protein, 6 aa, Homo sapiens
KVKIKL

SEQ ID NO: 16163 - protein, 6 aa, Homo sapiens
KVKIKL

SEQ ID NO: 16164 - protein, 18 aa, Homo sapiens
RGQPLPDHLQMAVQGKRP

SEQ ID NO: 16165 - protein, 8 aa, Homo sapiens
KLIDQKKD

SEQ ID NO: 16166 - protein, 7 aa, Homo sapiens
RNHKYRS

SEQ ID NO: 16167 - protein, 9 aa, Homo sapiens
RIRNHKYRS

SEQ ID NO: 16168 - protein, 8 aa, Homo sapiens
RKPVDFKK

SEQ ID NO: 16169 - protein, 18 aa, Homo sapiens
RKRDSDAGSSTPTTSTRS

SEQ ID NO: 16170 - protein, 18 aa, Homo sapiens
RKRDSDAGSSTPTTSTRS

SEQ ID NO: 16171 - protein, 18 aa, Homo sapiens
RKRDSDAGSSTPTTSTRS

SEQ ID NO: 16172 - protein, 18 aa, Homo sapiens
RKRDSDAGSSTPTTSTRS

SEQ ID NO: 16173 - protein, 18 aa, Homo sapiens
RKRDSDAGSSTPTTSTRS

SEQ ID NO: 16174 - protein, 18 aa, Homo sapiens
RKRDSDAGSSTPTTSTRS

SEQ ID NO: 16175 - protein, 18 aa, Homo sapiens
RKRDSDAGSSTPTTSTRS

SEQ ID NO: 16176 - protein, 18 aa, Homo sapiens
RKRDSDAGSSTPTTSTRS

SEQ ID NO: 16177 - protein, 16 aa, Homo sapiens
RHRKEVDYSDSLTEKQ

SEQ ID NO: 16178 - protein, 15 aa, Homo sapiens
KYLRLDGTTKAEDRG

SEQ ID NO: 16179 - protein, 17 aa, Homo sapiens
RLDGTTKAEDRGMLLKT

SEQ ID NO: 16180 - protein, 17 aa, Homo sapiens
RLDGTTKAEDRGMLLKT

SEQ ID NO: 16181 - protein, 17 aa, Homo sapiens
RLDGTTKAEDRGMLLKT

SEQ ID NO: 16182 - protein, 12 aa, Homo sapiens
RLDGTTKAEDRG

SEQ ID NO: 16183 - protein, 15 aa, Homo sapiens
KYLRLDGTTKAEDRG

SEQ ID NO: 16184 - protein, 12 aa, Homo sapiens
RLDGTTKAEDRG

SEQ ID NO: 16185 - protein, 9 aa, Homo sapiens
RITEKLEKQ

SEQ ID NO: 16186 - protein, 10 aa, Homo sapiens
KQQKIEQERK

SEQ ID NO: 16187 - protein, 22 aa, Homo sapiens
RLMEEDELPSWIIKDDAEVERL

SEQ ID NO: 16188 - protein, 22 aa, Homo sapiens
RLMEEDELPSWIIKDDAEVERL

SEQ ID NO: 16189 - protein, 22 aa, Homo sapiens
RLMEEDELPSWIIKDDAEVERL

SEQ ID NO: 16190 - protein, 22 aa, Homo sapiens
RLMEEDELPSWIIKDDAEVERL

SEQ ID NO: 16191 - protein, 8 aa, Homo sapiens
KLGRKEKA

SEQ ID NO: 16192 - protein, 7 aa, Homo sapiens
RLKGGRR

SEQ ID NO: 16193 - protein, 7 aa, Homo sapiens
RLKGGRR

SEQ ID NO: 16194 - protein, 16 aa, Homo sapiens
KLTKAVATYHANTERE

SEQ ID NO: 16195 - protein, 10 aa, Homo sapiens
RSVTGKIQKL

SEQ ID NO: 16196 - protein, 9 aa, Homo sapiens
RKEKAQDRL

SEQ ID NO: 16197 - protein, 9 aa, Homo sapiens
RKEKAQDRL

SEQ ID NO: 16198 - protein, 7 aa, Homo sapiens
KIKLGRK

SEQ ID NO: 16199 - protein, 7 aa, Homo sapiens
KIKLGRK

SEQ ID NO: 16200 - protein, 7 aa, Homo sapiens
KIKLGRK

SEQ ID NO: 16201 - protein, 7 aa, Homo sapiens
KIKLGRK

SEQ ID NO: 16202 - protein, 9 aa, Homo sapiens
RKEKAQDRL

SEQ ID NO: 16203 - protein, 9 aa, Homo sapiens
RKEKAQDRL

SEQ ID NO: 16204 - protein, 7 aa, Homo sapiens
KIKLGRK

SEQ ID NO: 16205 - protein, 7 aa, Homo sapiens
RLKGGRR

SEQ ID NO: 16206 - protein, 12 aa, Homo sapiens
KVSYKGSPAARR

SEQ ID NO: 16207 - protein, 7 aa, Homo sapiens
RNHKYRS

SEQ ID NO: 16208 - protein, 7 aa, Homo sapiens
RLKGGRR

SEQ ID NO: 16209 - protein, 9 aa, Homo sapiens
RIRNHKYRS

SEQ ID NO: 16210 - protein, 24 aa, Homo sapiens
RHIIENAKQDVDDEYGVSQALARG

SEQ ID NO: 16211 - protein, 12 aa, Homo sapiens
RLDGTTKAEDRG

SEQ ID NO: 16212 - protein, 18 aa, Homo sapiens
RKRDSDAGSSTPTTSTRS

SEQ ID NO: 16213 - protein, 7 aa, Homo sapiens
RLKGGRR

SEQ ID NO: 16214 - protein, 12 aa, Homo sapiens
KVSYKGSPAARR

SEQ ID NO: 16215 - protein, 18 aa, Homo sapiens
RLCTVNSVEEKILAAAKY

SEQ ID NO: 16216 - protein, 8 aa, Homo sapiens
RILPKLRA

SEQ ID NO: 16217 - protein, 18 aa, Homo sapiens
KVIQAGMFDQKSSSHERR

SEQ ID NO: 16218 - protein, 18 aa, Homo sapiens
KVIQAGMFDQKSSSHERR

SEQ ID NO: 16219 - protein, 18 aa, Homo sapiens
KVIQAGMFDQKSSSHERR

SEQ ID NO: 16220 - protein, 25 aa, Homo sapiens
RAGYAGEDCPKVDFPTAIGMVVERD

SEQ ID NO: 16221 - protein, 25 aa, Homo sapiens
RAGYAGEDCPKVDFPTAIGMVVERD

SEQ ID NO: 16222 - protein, 31 aa, Homo sapiens; identical to SEQ ID NO: 6559

SEQ ID NO: 16223 - protein, 38 aa, Homo sapiens; identical to SEQ ID NO: 6738

SEQ ID NO: 16224 - protein, 31 aa, Homo sapiens; identical to SEQ ID NO: 6559

SEQ ID NO: 16225 - protein, 38 aa, Homo sapiens; identical to SEQ ID NO: 6738

SEQ ID NO: 16226 - protein, 31 aa, Homo sapiens; identical to SEQ ID NO: 6559

SEQ ID NO: 16227 - protein, 25 aa, Homo sapiens
RAGYAGEDCPKVDFPTAIGMVVERD

SEQ ID NO: 16228 - protein, 25 aa, Homo sapiens
RAGYAGEDCPKVDFPTAIGMVVERD

SEQ ID NO: 16229 - protein, 25 aa, Homo sapiens
RAGYAGEDCPKVDFPTAIGMVVERD

SEQ ID NO: 16230 - protein, 31 aa, Homo sapiens; identical to SEQ ID NO: 6559

SEQ ID NO: 16231 - protein, 38 aa, Homo sapiens; identical to SEQ ID NO: 6738

SEQ ID NO: 16232 - protein, 31 aa, Homo sapiens; identical to SEQ ID NO: 6559

SEQ ID NO: 16233 - protein, 38 aa, Homo sapiens; identical to SEQ ID NO: 6738

SEQ ID NO: 16234 - protein, 38 aa, Homo sapiens; identical to SEQ ID NO: 6738

SEQ ID NO: 16235 - protein, 38 aa, Homo sapiens; identical to SEQ ID NO: 6738

SEQ ID NO: 16236 - protein, 31 aa, Homo sapiens; identical to SEQ ID NO: 6559

SEQ ID NO: 16237 - protein, 31 aa, Homo sapiens; identical to SEQ ID NO: 6559

SEQ ID NO: 16238 - protein, 31 aa, Homo sapiens; identical to SEQ ID NO: 6559

SEQ ID NO: 16239 - protein, 31 aa, Homo sapiens; identical to SEQ ID NO: 6559

SEQ ID NO: 16240 - protein, 25 aa, Homo sapiens
RAGYAGEDCPKVDFPTAIGMVVERD

SEQ ID NO: 16241 - protein, 25 aa, Homo sapiens
RAGYAGEDCPKVDFPTAIGMVVERD

SEQ ID NO: 16242 - protein, 31 aa, Homo sapiens; identical to SEQ ID NO: 6559

SEQ ID NO: 16243 - protein, 25 aa, Homo sapiens
RAGYAGEDCPKVDFPTAIGMVVERD

SEQ ID NO: 16244 - protein, 31 aa, Homo sapiens; identical to SEQ ID NO: 6559

SEQ ID NO: 16245 - protein, 31 aa, Homo sapiens; identical to SEQ ID NO: 6559

SEQ ID NO: 16246 - protein, 31 aa, Homo sapiens; identical to SEQ ID NO: 6559

SEQ ID NO: 16247 - protein, 25 aa, Homo sapiens
RAGYAGEDCPKVDFPTAIGMVVERD

SEQ ID NO: 16248 - protein, 25 aa, Homo sapiens
RAGYAGEDCPKVDFPTAIGMVVERD

SEQ ID NO: 16249 - protein, 31 aa, Homo sapiens; identical to SEQ ID NO: 6559

SEQ ID NO: 16250 - protein, 25 aa, Homo sapiens
RAGYAGEDCPKVDFPTAIGMVVERD

SEQ ID NO: 16251 - protein, 25 aa, Homo sapiens
RAGYAGEDCPKVDFPTAIGMVVERD

SEQ ID NO: 16252 - protein, 11 aa, Homo sapiens
RKEKLPQVTRS

SEQ ID NO: 16253 - protein, 15 aa, Homo sapiens
KEAVREGSPANWKRK

SEQ ID NO: 16254 - protein, 11 aa, Homo sapiens
RKEKLPQVTRS

SEQ ID NO: 16255 - protein, 11 aa, Homo sapiens
REGSPANWKRK

SEQ ID NO: 16256 - protein, 11 aa, Homo sapiens
REGSPANWKRK

SEQ ID NO: 16257 - protein, 11 aa, Homo sapiens
RKEKLPQVTRS

SEQ ID NO: 16258 - protein, 11 aa, Homo sapiens
RKEKLPQVTRS

SEQ ID NO: 16259 - protein, 11 aa, Homo sapiens
RKEKLPQVTRS

SEQ ID NO: 16260 - protein, 11 aa, Homo sapiens
REGSPANWKRK

SEQ ID NO: 16261 - protein, 11 aa, Homo sapiens
REGSPANWKRK

SEQ ID NO: 16262 - protein, 11 aa, Homo sapiens
RKEKLPQVTRS

SEQ ID NO: 16263 - protein, 11 aa, Homo sapiens
REGSPANWKRK

SEQ ID NO: 16264 - protein, 11 aa, Homo sapiens
REGSPANWKRK

SEQ ID NO: 16265 - protein, 11 aa, Homo sapiens
REGSPANWKRK

SEQ ID NO: 16266 - protein, 11 aa, Homo sapiens
RKEKLPQVTRS

SEQ ID NO: 16267 - protein, 11 aa, Homo sapiens
RKEKLPQVTRS

SEQ ID NO: 16268 - protein, 11 aa, Homo sapiens
RKEKLPQVTRS

SEQ ID NO: 16269 - protein, 11 aa, Homo sapiens
RKEKLPQVTRS

SEQ ID NO: 16270 - protein, 11 aa, Homo sapiens
RKEKLPQVTRS

SEQ ID NO: 16271 - protein, 11 aa, Homo sapiens
REGSPANWKRK

SEQ ID NO: 16272 - protein, 11 aa, Homo sapiens
RKEKLPQVTRS

SEQ ID NO: 16273 - protein, 15 aa, Homo sapiens
KEAVREGSPANWKRK

SEQ ID NO: 16274 - protein, 11 aa, Homo sapiens
REGSPANWKRK

SEQ ID NO: 16275 - protein, 11 aa, Homo sapiens
REGSPANWKRK

SEQ ID NO: 16276 - protein, 11 aa, Homo sapiens
REGSPANWKRK

SEQ ID NO: 16277 - protein, 15 aa, Homo sapiens
KEAVREGSPANWKRK

SEQ ID NO: 16278 - protein, 15 aa, Homo sapiens
KEAVREGSPANWKRK

SEQ ID NO: 16279 - protein, 11 aa, Homo sapiens
REGSPANWKRK

SEQ ID NO: 16280 - protein, 15 aa, Homo sapiens
KQEYEEGGKQCVERK

SEQ ID NO: 16281 - protein, 15 aa, Homo sapiens
KQEYEEGGKQCVERK

SEQ ID NO: 16282 - protein, 15 aa, Homo sapiens
KQEYEEGGKQCVERK

SEQ ID NO: 16283 - protein, 22 aa, Homo sapiens
REKLTELMFEHYNIPAFFLCKT

SEQ ID NO: 16284 - protein, 15 aa, Homo sapiens
KQEYEEGGKQCVERK

SEQ ID NO: 16285 - protein, 11 aa, Homo sapiens
RKEKLPQVTRS

SEQ ID NO: 16286 - protein, 25 aa, Homo sapiens
RELFQEMNIELVPPYMIASKEAVRE

SEQ ID NO: 16287 - protein, 25 aa, Homo sapiens
RELFQEMNIELVPPYMIASKEAVRE

SEQ ID NO: 16288 - protein, 25 aa, Homo sapiens
RELFQEMNIELVPPYMIASKEAVRE

SEQ ID NO: 16289 - protein, 25 aa, Homo sapiens
RELFQEMNIELVPPYMIASKEAVRE

SEQ ID NO: 16290 - protein, 11 aa, Homo sapiens
RKEKLPQVTRS

SEQ ID NO: 16291 - protein, 25 aa, Homo sapiens
RELFQEMNIELVPPYMIASKEAVRE

SEQ ID NO: 16292 - protein, 25 aa, Homo sapiens
RELFQEMNIELVPPYMIASKEAVRE

SEQ ID NO: 16293 - protein, 14 aa, Homo sapiens
RLKLIANNTTVERR

SEQ ID NO: 16294 - protein, 15 aa, Homo sapiens
RLKLIANNTTVERRF

SEQ ID NO: 16295 - protein, 8 aa, Homo sapiens
RGSLYKRY

SEQ ID NO: 16296 - protein, 17 aa, Homo sapiens
RKAIVICPTDEDLKDRT

SEQ ID NO: 16297 - protein, 17 aa, Homo sapiens
RKAIVICPTDEDLKDRT

SEQ ID NO: 16298 - protein, 17 aa, Homo sapiens
RKAIVICPTDEDLKDRT

SEQ ID NO: 16299 - protein, 17 aa, Homo sapiens
RKAIVICPTDEDLKDRT

SEQ ID NO: 16300 - protein, 10 aa, Homo sapiens
RGTVGPKSKA

SEQ ID NO: 16301 - protein, 21 aa, Homo sapiens
KQGAPTSFLPPEASQLKPDRQ

SEQ ID NO: 16302 - protein, 23 aa, Homo sapiens
KINEEISVKHLPSTEPDPHVVRI

SEQ ID NO: 16303 - protein, 23 aa, Homo sapiens
KINEEISVKHLPSTEPDPHVVRI

SEQ ID NO: 16304 - protein, 23 aa, Homo sapiens
KINEEISVKHLPSTEPDPHVVRI

SEQ ID NO: 16305 - protein, 8 aa, Homo sapiens
KKSTNSRF

SEQ ID NO: 16306 - protein, 23 aa, Homo sapiens
KINEEISVKHLPSTEPDPHVVRI

SEQ ID NO: 16307 - protein, 22 aa, Homo sapiens
RQNQFYDTQVIKQENESGYERR

SEQ ID NO: 16308 - protein, 10 aa, Homo sapiens
RKRPYEENRG

SEQ ID NO: 16309 - protein, 21 aa, Homo sapiens
RPLEMEQQQAYRPEMKTEMKQ

SEQ ID NO: 16310 - protein, 16 aa, Homo sapiens
KAIVICPTDEDLKDRT

SEQ ID NO: 16311 - protein, 17 aa, Homo sapiens
KTTWAIKHAASNPSKKY

SEQ ID NO: 16312 - protein, 15 aa, Homo sapiens
KKYNILGTNAIMDKM

SEQ ID NO: 16313 - protein, 14 aa, Homo sapiens
RLKVNELREELQRR

SEQ ID NO: 16314 - protein, 14 aa, Homo sapiens
RLKVNELREELQRR

SEQ ID NO: 16315 - protein, 14 aa, Homo sapiens
RLKVNELREELQRR

SEQ ID NO: 16316 - protein, 10 aa, Homo sapiens
RKRPYEENRG

SEQ ID NO: 16317 - protein, 10 aa, Homo sapiens
RKRPYEENRG

SEQ ID NO: 16318 - protein, 10 aa, Homo sapiens
RKRPYEENRG

SEQ ID NO: 16319 - protein, 23 aa, Homo sapiens
KINEEISVKHLPSTEPDPHVVRI

SEQ ID NO: 16320 - protein, 23 aa, Homo sapiens
KINEEISVKHLPSTEPDPHVVRI

SEQ ID NO: 16321 - protein, 5 aa, Homo sapiens
RKKRR

SEQ ID NO: 16322 - protein, 28 aa, Homo sapiens
RLTALLLPPDPIVINHVISVDPSDQKKT

SEQ ID NO: 16323 - protein, 29 aa, Homo sapiens
RLYISNTFNPAKPDAEDSDGSIASWELRV

SEQ ID NO: 16324 - protein, 29 aa, Homo sapiens
RLYISNTFNPAKPDAEDSDGSIASWELRV

SEQ ID NO: 16325 - protein, 9 aa, Homo sapiens
RKLIDQKKD

SEQ ID NO: 16326 - protein, 7 aa, Homo sapiens
RIEKERM

SEQ ID NO: 16327 - protein, 6 aa, Homo sapiens
KKDRRL

SEQ ID NO: 16328 - protein, 10 aa, Homo sapiens
RSRAKDDIKK

SEQ ID NO: 16329 - protein, 10 aa, Homo sapiens
KKVMATIEKV

SEQ ID NO: 16330 - protein, 8 aa, Homo sapiens
RAKDDIKK

SEQ ID NO: 16331 - protein, 11 aa, Homo sapiens
KVMATIEKVRR

SEQ ID NO: 16332 - protein, 13 aa, Homo sapiens
KQASKFDKLPIKI

SEQ ID NO: 16333 - protein, 13 aa, Homo sapiens
KQASKFDKLPIKI

SEQ ID NO: 16334 - protein, 13 aa, Homo sapiens
KQASKFDKLPIKI

SEQ ID NO: 16335 - protein, 12 aa, Homo sapiens
KFDKLPIKIVKK

SEQ ID NO: 16336 - protein, 12 aa, Homo sapiens
KFDKLPIKIVKK

SEQ ID NO: 16337 - protein, 12 aa, Homo sapiens
RQEKFYATLVRY

SEQ ID NO: 16338 - protein, 12 aa, Homo sapiens
RQEKFYATLVRY

SEQ ID NO: 16339 - protein, 12 aa, Homo sapiens
RQEKFYATLVRY

SEQ ID NO: 16340 - protein, 23 aa, Homo sapiens
RSSTISVHDPFSDVSDSSFPKRN

SEQ ID NO: 16341 - protein, 23 aa, Homo sapiens
RSSTISVHDPFSDVSDSSFPKRN

SEQ ID NO: 16342 - protein, 23 aa, Homo sapiens
RSSTISVHDPFSDVSDSSFPKRN

SEQ ID NO: 16343 - protein, 22 aa, Homo sapiens
RKAQEAAAAVMQAAANSAQSRQ

SEQ ID NO: 16344 - protein, 22 aa, Homo sapiens
RKAQEAAAAVMQAAANSAQSRQ

SEQ ID NO: 16345 - protein, 42 aa, Homo sapiens
RKVPGSSEPFMTQGQMPNSSMQDMYNQSPSGAMSNLGMGQRQ

SEQ ID NO: 16346 - protein, 42 aa, Homo sapiens; identical to SEQ ID NO: 16345

SEQ ID NO: 16347 - protein, 29 aa, Homo sapiens
KAEGDSAGTAGTPGGTPAGDKVASWELRV

SEQ ID NO: 16348 - protein, 40 aa, Homo sapiens; identical to SEQ ID NO: 5831

SEQ ID NO: 16349 - protein, 29 aa, Homo sapiens
KAEGDSAGTAGTPGGTPAGDKVASWELRV

SEQ ID NO: 16350 - protein, 40 aa, Homo sapiens; identical to SEQ ID NO: 5831

SEQ ID NO: 16351 - protein, 24 aa, Homo sapiens
RPGDLNVKCTLLLMLDHQPPQYKL

SEQ ID NO: 16352 - protein, 24 aa, Homo sapiens
RPGDLNVKCTLLLMLDHQPPQYKL

SEQ ID NO: 16353 - protein, 24 aa, Homo sapiens
RPGDLNVKCTLLLMLDHQPPQYKL

SEQ ID NO: 16354 - protein, 24 aa, Homo sapiens
RPGDLNVKCTLLLMLDHQPPQYKL

SEQ ID NO: 16355 - protein, 25 aa, Homo sapiens
KRPGDLNVKCTLLLMLDHQPPQYKL

SEQ ID NO: 16356 - protein, 25 aa, Homo sapiens
KRPGDLNVKCTLLLMLDHQPPQYKL

SEQ ID NO: 16357 - protein, 40 aa, Homo sapiens; identical to SEQ ID NO: 5831

SEQ ID NO: 16358 - protein, 40 aa, Homo sapiens; identical to SEQ ID NO: 5831

SEQ ID NO: 16359 - protein, 40 aa, Homo sapiens; identical to SEQ ID NO: 5831

SEQ ID NO: 16360 - protein, 40 aa, Homo sapiens; identical to SEQ ID NO: 5831

SEQ ID NO: 16361 - protein, 40 aa, Homo sapiens; identical to SEQ ID NO: 5831

SEQ ID NO: 16362 - protein, 33 aa, Homo sapiens; identical to SEQ ID NO: 5834

SEQ ID NO: 16363 - protein, 23 aa, Homo sapiens
RMPTTQETDGFQVKRPGDLNVKC

SEQ ID NO: 16364 - protein, 33 aa, Homo sapiens; identical to SEQ ID NO: 5834

SEQ ID NO: 16365 - protein, 40 aa, Homo sapiens; identical to SEQ ID NO: 5831

SEQ ID NO: 16366 - protein, 33 aa, Homo sapiens; identical to SEQ ID NO: 5834

SEQ ID NO: 16367 - protein, 33 aa, Homo sapiens; identical to SEQ ID NO: 5834

SEQ ID NO: 16368 - protein, 12 aa, Homo sapiens
KRMEIQEAIKKP

SEQ ID NO: 16369 - protein, 11 aa, Homo sapiens
RMEIQEAIKKP

SEQ ID NO: 16370 - protein, 11 aa, Homo sapiens
RMEIQEAIKKP

SEQ ID NO: 16371 - protein, 28 aa, Homo sapiens
KLAGLLQHPDPIVINHVISVDPNDQKKT

SEQ ID NO: 16372 - protein, 28 aa, Homo sapiens
KLAGLLQHPDPIVINHVISVDPNDQKKT

SEQ ID NO: 16373 - protein, 27 aa, Homo sapiens
RLCGLKVEVDMEKIAAEIAQAEEQARK

SEQ ID NO: 16374 - protein, 16 aa, Homo sapiens
KFLESTDSFNNELKRL

SEQ ID NO: 16375 - protein, 27 aa, Homo sapiens
RLCGLKVEVDMEKIAAEIAQAEEQARK

SEQ ID NO: 16376 - protein, 27 aa, Homo sapiens
RLCGLKVEVDMEKIAAEIAQAEEQARK

SEQ ID NO: 16377 - protein, 16 aa, Homo sapiens
KFLESTDSFNNELKRL

SEQ ID NO: 16378 - protein, 27 aa, Homo sapiens
RLCGLKVEVDMEKIAAEIAQAEEQARK

SEQ ID NO: 16379 - protein, 27 aa, Homo sapiens
RLCGLKVEVDMEKIAAEIAQAEEQARK

SEQ ID NO: 16380 - protein, 27 aa, Homo sapiens
RLCGLKVEVDMEKIAAEIAQAEEQARK

SEQ ID NO: 16381 - protein, 16 aa, Homo sapiens
KFLESTDSFNNELKRL

SEQ ID NO: 16382 - protein, 27 aa, Homo sapiens
RLCGLKVEVDMEKIAAEIAQAEEQARK

SEQ ID NO: 16383 - protein, 27 aa, Homo sapiens
RLCGLKVEVDMEKIAAEIAQAEEQARK

SEQ ID NO: 16384 - protein, 27 aa, Homo sapiens
RLCGLKVEVDMEKIAAEIAQAEEQARK

SEQ ID NO: 16385 - protein, 27 aa, Homo sapiens
RLCGLKVEVDMEKIAAEIAQAEEQARK

SEQ ID NO: 16386 - protein, 17 aa, Homo sapiens
RKFLESTDSFNNELKRL

SEQ ID NO: 16387 - protein, 12 aa, Homo sapiens
REKEAAEQAERS

SEQ ID NO: 16388 - protein, 26 aa, Homo sapiens
KKGPDGLALPNNYCDFCLGDSKINKK

SEQ ID NO: 16389 - protein, 26 aa, Homo sapiens
KKGPDGLALPNNYCDFCLGDSKINKK

SEQ ID NO: 16390 - protein, 10 aa, Homo sapiens
KGKGVGSARK

SEQ ID NO: 16391 - protein, 23 aa, Homo sapiens
RSGHPSCLQFTPVMMAAVKTYRW

SEQ ID NO: 16392 - protein, 23 aa, Homo sapiens
RSGHPSCLQFTPVMMAAVKTYRW

SEQ ID NO: 16393 - protein, 23 aa, Homo sapiens
RSGHPSCLQFTPVMMAAVKTYRW

SEQ ID NO: 16394 - protein, 21 aa, Homo sapiens
KINKKTGQPEELVSCSDCGRS

SEQ ID NO: 16395 - protein, 26 aa, Homo sapiens
KKGPDGLALPNNYCDFCLGDSKINKK

SEQ ID NO: 16396 - protein, 26 aa, Homo sapiens
KKGPDGLALPNNYCDFCLGDSKINKK

SEQ ID NO: 16397 - protein, 23 aa, Homo sapiens
KKGPDGLALPNNYCDFCLGDSKI

SEQ ID NO: 16398 - protein, 9 aa, Homo sapiens
RSEEQKSKK

SEQ ID NO: 16399 - protein, 23 aa, Homo sapiens
KKGPDGLALPNNYCDFCLGDSKI

SEQ ID NO: 16400 - protein, 9 aa, Homo sapiens
RSEEQKSKK

SEQ ID NO: 16401 - protein, 9 aa, Homo sapiens
RSEEQKSKK

SEQ ID NO: 16402 - protein, 9 aa, Homo sapiens
RSEEQKSKK

SEQ ID NO: 16403 - protein, 9 aa, Homo sapiens
RTDPLEKRG

SEQ ID NO: 16404 - protein, 19 aa, Homo sapiens
KKEGLISQDGSSLEALLRT

SEQ ID NO: 16405 - protein, 19 aa, Homo sapiens
KKEGLISQDGSSLEALLRT

SEQ ID NO: 16406 - protein, 9 aa, Homo sapiens
RTDPLEKRG

SEQ ID NO: 16407 - protein, 19 aa, Homo sapiens
KKEGLISQDGSSLEALLRT

SEQ ID NO: 16408 - protein, 26 aa, Homo sapiens
RILEPDDFLDDLDDEDYEEDTPKRRG

SEQ ID NO: 16409 - protein, 25 aa, Homo sapiens
RILEPDDFLDDLDDEDYEEDTPKRR

SEQ ID NO: 16410 - protein, 25 aa, Homo sapiens
RILEPDDFLDDLDDEDYEEDTPKRR

SEQ ID NO: 16411 - protein, 19 aa, Homo sapiens
KKVVDDLLDQITGGDHSRT

SEQ ID NO: 16412 - protein, 19 aa, Homo sapiens
KKVVDDLLDQITGGDHSRT

SEQ ID NO: 16413 - protein, 10 aa, Homo sapiens
RTLFQLKQRR

SEQ ID NO: 16414 - protein, 4 aa, Homo sapiens
RKCF

SEQ ID NO: 16415 - protein, 4 aa, Homo sapiens
RKCF

SEQ ID NO: 16416 - protein, 30 aa, Homo sapiens
KCDVDIRKDLYANTVLSGGTTMYPGIADRM

SEQ ID NO: 16417 - protein, 30 aa, Homo sapiens; identical to SEQ ID NO: 16416

SEQ ID NO: 16418 - protein, 24 aa, Homo sapiens
RKDLYANTVLSGGTTMYPGIADRM

SEQ ID NO: 16419 - protein, 30 aa, Homo sapiens; identical to SEQ ID NO: 16416

SEQ ID NO: 16420 - protein, 11 aa, Homo sapiens
KIKIIAPPERK

SEQ ID NO: 16421 - protein, 24 aa, Homo sapiens
RKDLYANTVLSGGTTMYPGIADRM

SEQ ID NO: 16422 - protein, 22 aa, Homo sapiens
KEITALAPSTMKIKIIAPPERK

SEQ ID NO: 16423 - protein, 24 aa, Homo sapiens
RKDLYANTVLSGGTTMYPGIADRM

SEQ ID NO: 16424 - protein, 24 aa, Homo sapiens
RKDLYANTVLSGGTTMYPGIADRM

SEQ ID NO: 16425 - protein, 11 aa, Homo sapiens
KIKIIAPPERK

SEQ ID NO: 16426 - protein, 11 aa, Homo sapiens
KIKIIAPPERK

SEQ ID NO: 16427 - protein, 24 aa, Homo sapiens
RKDLYANTVLSGGTTMYPGIADRM

SEQ ID NO: 16428 - protein, 24 aa, Homo sapiens
RKDLYANTVLSGGTTMYPGIADRM

SEQ ID NO: 16429 - protein, 11 aa, Homo sapiens
KIKIIAPPERK

SEQ ID NO: 16430 - protein, 11 aa, Homo sapiens
KIKIIAPPERK

SEQ ID NO: 16431 - protein, 11 aa, Homo sapiens
KIKIIAPPERK

SEQ ID NO: 16432 - protein, 30 aa, Homo sapiens; identical to SEQ ID NO: 16416

SEQ ID NO: 16433 - protein, 24 aa, Homo sapiens
RKDLYANTVLSGGTTMYPGIADRM

SEQ ID NO: 16434 - protein, 11 aa, Homo sapiens
KIKIIAPPERK

SEQ ID NO: 16435 - protein, 24 aa, Homo sapiens
RKDLYANTVLSGGTTMYPGIADRM

SEQ ID NO: 16436 - protein, 24 aa, Homo sapiens
RKDLYANTVLSGGTTMYPGIADRM

SEQ ID NO: 16437 - protein, 24 aa, Homo sapiens
RKDLYANTVLSGGTTMYPGIADRM

SEQ ID NO: 16438 - protein, 24 aa, Homo sapiens
RKDLYANTVLSGGTTMYPGIADRM

SEQ ID NO: 16439 - protein, 24 aa, Homo sapiens
RKDLYANTVLSGGTTMYPGIADRM

SEQ ID NO: 16440 - protein, 30 aa, Homo sapiens; identical to SEQ ID NO: 16416

SEQ ID NO: 16441 - protein, 30 aa, Homo sapiens; identical to SEQ ID NO: 16416

SEQ ID NO: 16442 - protein, 24 aa, Homo sapiens
RKDLYANTVLSGGTTMYPGIADRM

SEQ ID NO: 16443 - protein, 30 aa, Homo sapiens; identical to SEQ ID NO: 16416

SEQ ID NO: 16444 - protein, 30 aa, Homo sapiens; identical to SEQ ID NO: 16416

SEQ ID NO: 16445 - protein, 22 aa, Homo sapiens
KEITALAPSTMKIKIIAPPERK

SEQ ID NO: 16446 - protein, 15 aa, Homo sapiens
KEITALAPSTMKIKI

SEQ ID NO: 16447 - protein, 15 aa, Homo sapiens
KEITALAPSTMKIKI

SEQ ID NO: 16448 - protein, 30 aa, Homo sapiens; identical to SEQ ID NO: 16416

SEQ ID NO: 16449 - protein, 15 aa, Homo sapiens
KEITALAPSTMKIKI

SEQ ID NO: 16450 - protein, 11 aa, Homo sapiens
KVEEAAKVTGK

SEQ ID NO: 16451 - protein, 7 aa, Homo sapiens
TDMYTKK

SEQ ID NO: 16452 - protein, 9 aa, Homo sapiens
SKAAASATR

SEQ ID NO: 16453 - protein, 9 aa, Homo sapiens
SKAAASATR

SEQ ID NO: 16454 - protein, 9 aa, Homo sapiens
SKAAASATR

SEQ ID NO: 16455 - protein, 10 aa, Homo sapiens
AKHLAAVEER

SEQ ID NO: 16456 - protein, 15 aa, Homo sapiens
MKEEVPTALVEAHVR

SEQ ID NO: 16457 - protein, 7 aa, Homo sapiens
KVEEAAK

SEQ ID NO: 16458 - protein, 15 aa, Homo sapiens
MKEEVPTALVEAHVR

SEQ ID NO: 16459 - protein, 23 aa, Homo sapiens
SALEEFSKMKEEVPTALVEAHVR

SEQ ID NO: 16460 - protein, 7 aa, Homo sapiens
KVEEAAK

SEQ ID NO: 16461 - protein, 15 aa, Homo sapiens
MKEEVPTALVEAHVR

SEQ ID NO: 16462 - protein, 15 aa, Homo sapiens
MKEEVPTALVEAHVR

SEQ ID NO: 16463 - protein, 12 aa, Homo sapiens
RALPEFFNGKNK

SEQ ID NO: 16464 - protein, 11 aa, Homo sapiens
SKTPEIYLAYR

SEQ ID NO: 16465 - protein, 9 aa, Homo sapiens
SKAAASATR

SEQ ID NO: 16466 - protein, 14 aa, Homo sapiens
TVNTKKDSESAPVK

SEQ ID NO: 16467 - protein, 30 aa, Homo sapiens; identical to SEQ ID NO: 8343

SEQ ID NO: 16468 - protein, 30 aa, Homo sapiens; identical to SEQ ID NO: 8343

SEQ ID NO: 16469 - protein, 30 aa, Homo sapiens; identical to SEQ ID NO: 8343

SEQ ID NO: 16470 - protein, 30 aa, Homo sapiens; identical to SEQ ID NO: 8343

SEQ ID NO: 16471 - protein, 14 aa, Homo sapiens
TVNTKKDSESAPVK

SEQ ID NO: 16472 - protein, 30 aa, Homo sapiens; identical to SEQ ID NO: 8343

SEQ ID NO: 16473 - protein, 30 aa, Homo sapiens; identical to SEQ ID NO: 8343

SEQ ID NO: 16474 - protein, 30 aa, Homo sapiens; identical to SEQ ID NO: 8343

SEQ ID NO: 16475 - protein, 11 aa, Homo sapiens
KVEEAAKVTGK

SEQ ID NO: 16476 - protein, 11 aa, Homo sapiens
KVEEAAKVTGK

SEQ ID NO: 16477 - protein, 11 aa, Homo sapiens
KVEEAAKVTGK

SEQ ID NO: 16478 - protein, 6 aa, Homo sapiens
KTKVER

SEQ ID NO: 16479 - protein, 11 aa, Homo sapiens
KVEEAAKVTGK

SEQ ID NO: 16480 - protein, 26 aa, Homo sapiens
SLVQNNCLSRPNIFLCPEIEPKLLGK

SEQ ID NO: 16481 - protein, 15 aa, Homo sapiens
VASAAAKSALEEFSK

SEQ ID NO: 16482 - protein, 15 aa, Homo sapiens
VASAAAKSALEEFSK

SEQ ID NO: 16483 - protein, 23 aa, Homo sapiens
SALEEFSKMKEEVPTALVEAHVR

SEQ ID NO: 16484 - protein, 15 aa, Homo sapiens
VASAAAKSALEEFSK

SEQ ID NO: 16485 - protein, 15 aa, Homo sapiens
VASAAAKSALEEFSK

SEQ ID NO: 16486 - protein, 5 aa, Homo sapiens
TKVER

SEQ ID NO: 16487 - protein, 5 aa, Homo sapiens
TKVER

SEQ ID NO: 16488 - protein, 23 aa, Homo sapiens
DMDEPSPVPNVEEVTLPKTVNTK

SEQ ID NO: 16489 - protein, 36 aa, Homo sapiens; identical to SEQ ID NO: 8480

SEQ ID NO: 16490 - protein, 7 aa, Homo sapiens
KVEEAAK

SEQ ID NO: 16491 - protein, 7 aa, Homo sapiens
KVEEAAK

SEQ ID NO: 16492 - protein, 10 aa, Homo sapiens
AKHLAAVEER

SEQ ID NO: 16493 - protein, 14 aa, Homo sapiens
GKEKPTDMQNFGLR

SEQ ID NO: 16494 - protein, 14 aa, Homo sapiens
GKEKPTDMQNFGLR

SEQ ID NO: 16495 - protein, 18 aa, Homo sapiens
ISAKTLTDEVNSPDSDRR

SEQ ID NO: 16496 - protein, 18 aa, Homo sapiens
ISAKTLTDEVNSPDSDRR

SEQ ID NO: 16497 - protein, 11 aa, Homo sapiens
AKHLAAVEERK

SEQ ID NO: 16498 - protein, 18 aa, Homo sapiens
EGQEEVLKEVVESEGERK

SEQ ID NO: 16499 - protein, 26 aa, Homo sapiens
TKVERDIGEGNLSTAAAAALAAAAVK

SEQ ID NO: 16500 - protein, 6 aa, Homo sapiens
KTKVER

SEQ ID NO: 16501 - protein, 6 aa, Homo sapiens
KTKVER

SEQ ID NO: 16502 - protein, 17 aa, Homo sapiens
EGQEEVLKEVVESEGER

SEQ ID NO: 16503 - protein, 17 aa, Homo sapiens
EGQEEVLKEVVESEGER

SEQ ID NO: 16504 - protein, 16 aa, Homo sapiens
AGGSLCHILAAAYKFK

SEQ ID NO: 16505 - protein, 19 aa, Homo sapiens
TPQQTSASQQMLNFPDKGK

SEQ ID NO: 16506 - protein, 12 aa, Homo sapiens
EKPTDMQNFGLR

SEQ ID NO: 16507 - protein, 19 aa, Homo sapiens
TPQQTSASQQMLNFPDKGK

SEQ ID NO: 16508 - protein, 19 aa, Homo sapiens
TPQQTSASQQMLNFPDKGK

SEQ ID NO: 16509 - protein, 12 aa, Homo sapiens
EKPTDMQNFGLR

SEQ ID NO: 16510 - protein, 12 aa, Homo sapiens
EKPTDMQNFGLR

SEQ ID NO: 16511 - protein, 12 aa, Homo sapiens
EKPTDMQNFGLR

SEQ ID NO: 16512 - protein, 12 aa, Homo sapiens
EKPTDMQNFGLR

SEQ ID NO: 16513 - protein, 12 aa, Homo sapiens
EKPTDMQNFGLR

SEQ ID NO: 16514 - protein, 12 aa, Homo sapiens
EKPTDMQNFGLR

SEQ ID NO: 16515 - protein, 19 aa, Homo sapiens
TPQQTSASQQMLNFPDKGK

SEQ ID NO: 16516 - protein, 9 aa, Homo sapiens
SKAAASATR

SEQ ID NO: 16517 - protein, 9 aa, Homo sapiens
SKAAASATR

SEQ ID NO: 16518 - protein, 9 aa, Homo sapiens
SKAAASATR

SEQ ID NO: 16519 - protein, 19 aa, Homo sapiens
KRPAPQQIQQVQQQAVQNR

SEQ ID NO: 16520 - protein, 16 aa, Homo sapiens
DLKTMTDVVGNPEEER

SEQ ID NO: 16521 - protein, 27 aa, Homo sapiens
IFISNTFNPAKSDAEDGEGTVASWELR

SEQ ID NO: 16522 - protein, 31 aa, Homo sapiens; identical to SEQ ID NO: 8609

SEQ ID NO: 16523 - protein, 27 aa, Homo sapiens
IFISNTFNPAKSDAEDGEGTVASWELR

SEQ ID NO: 16524 - protein, 31 aa, Homo sapiens; identical to SEQ ID NO: 8609

SEQ ID NO: 16525 - protein, 27 aa, Homo sapiens
IFISNTFNPAKSDAEDGEGTVASWELR

SEQ ID NO: 16526 - protein, 27 aa, Homo sapiens
IFISNTFNPAKSDAEDGEGTVASWELR

SEQ ID NO: 16527 - protein, 31 aa, Homo sapiens; identical to SEQ ID NO: 8609

SEQ ID NO: 16528 - protein, 27 aa, Homo sapiens
IFISNTFNPAKSDAEDGEGTVASWELR

SEQ ID NO: 16529 - protein, 27 aa, Homo sapiens
IFISNTFNPAKSDAEDGEGTVASWELR

SEQ ID NO: 16530 - protein, 31 aa, Homo sapiens; identical to SEQ ID NO: 8609

SEQ ID NO: 16531 - protein, 27 aa, Homo sapiens
IFISNTFNPAKSDAEDGEGTVASWELR

SEQ ID NO: 16532 - protein, 31 aa, Homo sapiens; identical to SEQ ID NO: 8609

SEQ ID NO: 16533 - protein, 31 aa, Homo sapiens; identical to SEQ ID NO: 8609

SEQ ID NO: 16534 - protein, 27 aa, Homo sapiens
IFISNTFNPAKSDAEDGEGTVASWELR

SEQ ID NO: 16535 - protein, 27 aa, Homo sapiens
IFISNTFNPAKSDAEDGEGTVASWELR

SEQ ID NO: 16536 - protein, 27 aa, Homo sapiens
IFISNTFNPAKSDAEDGEGTVASWELR

SEQ ID NO: 16537 - protein, 31 aa, Homo sapiens; identical to SEQ ID NO: 8609

SEQ ID NO: 16538 - protein, 31 aa, Homo sapiens; identical to SEQ ID NO: 8609

SEQ ID NO: 16539 - protein, 31 aa, Homo sapiens; identical to SEQ ID NO: 8609

SEQ ID NO: 16540 - protein, 27 aa, Homo sapiens
IFISNTFNPAKSDAEDGEGTVASWELR

SEQ ID NO: 16541 - protein, 26 aa, Homo sapiens
LHALLMPPEPIIINHVISVDPNDQKK

SEQ ID NO: 16542 - protein, 9 aa, Homo sapiens
LDIQEALKR

SEQ ID NO: 16543 - protein, 9 aa, Homo sapiens
LDIQEALKR

SEQ ID NO: 16544 - protein, 9 aa, Homo sapiens
LDIQEALKR

SEQ ID NO: 16545 - protein, 9 aa, Homo sapiens
MKFSEIPQR

SEQ ID NO: 16546 - protein, 5 aa, Homo sapiens
KKSGK

SEQ ID NO: 16547 - protein, 5 aa, Homo sapiens
KKSGK

SEQ ID NO: 16548 - protein, 31 aa, Homo sapiens
SQKEEDEQEDLTKDMEDPTPVPNIEEVVLPK

SEQ ID NO: 16549 - protein, 31 aa, Homo sapiens; identical to SEQ ID NO: 16548

SEQ ID NO: 16550 - protein, 31 aa, Homo sapiens; identical to SEQ ID NO: 16548

SEQ ID NO: 16551 - protein, 14 aa, Homo sapiens
ISTKNEEPVRSPER

SEQ ID NO: 16552 - protein, 14 aa, Homo sapiens
ISTKNEEPVRSPER

SEQ ID NO: 16553 - protein, 14 aa, Homo sapiens
ISTKNEEPVRSPER

SEQ ID NO: 16554 - protein, 5 aa, Homo sapiens
KKSGK

SEQ ID NO: 16555 - protein, 9 aa, Homo sapiens
KGQASLYGK

SEQ ID NO: 16556 - protein, 9 aa, Homo sapiens
DRKASANAR

SEQ ID NO: 16557 - protein, 8 aa, Homo sapiens
KDGGPATK

SEQ ID NO: 16558 - protein, 7 aa, Homo sapiens
KVQEAAR

SEQ ID NO: 16559 - protein, 7 aa, Homo sapiens
KVQEAAR

SEQ ID NO: 16560 - protein, 7 aa, Homo sapiens
KVQEAAR

SEQ ID NO: 16561 - protein, 9 aa, Homo sapiens
DRKASANAR

SEQ ID NO: 16562 - protein, 31 aa, Homo sapiens; identical to SEQ ID NO: 16548

SEQ ID NO: 16563 - protein, 9 aa, Homo sapiens
GQASLYGKR

SEQ ID NO: 16564 - protein, 10 aa, Homo sapiens
GQASLYGKRR

SEQ ID NO: 16565 - protein, 10 aa, Homo sapiens
GQASLYGKRR

SEQ ID NO: 16566 - protein, 22 aa, Homo sapiens
DGGPATKFWESPETVSQLDSVR

SEQ ID NO: 16567 - protein, 25 aa, Homo sapiens
KVEHEISEGNVATAAAAALASAATK

SEQ ID NO: 16568 - protein, 25 aa, Homo sapiens
KVEHEISEGNVATAAAAALASAATK

SEQ ID NO: 16569 - protein, 25 aa, Homo sapiens
KVEHEISEGNVATAAAAALASAATK

SEQ ID NO: 16570 - protein, 25 aa, Homo sapiens
KVEHEISEGNVATAAAAALASAATK

SEQ ID NO: 16571 - protein, 25 aa, Homo sapiens
KVEHEISEGNVATAAAAALASAATK

SEQ ID NO: 16572 - protein, 25 aa, Homo sapiens
KVEHEISEGNVATAAAAALASAATK

SEQ ID NO: 16573 - protein, 16 aa, Homo sapiens
VREEVPLELVEAHVKK

SEQ ID NO: 16574 - protein, 32 aa, Homo sapiens
GGTVADLDEQDEETVTAGGKEDEDPAKGDQSR

SEQ ID NO: 16575 - protein, 32 aa, Homo sapiens; identical to SEQ ID NO: 16574

SEQ ID NO: 16576 - protein, 15 aa, Homo sapiens
VASAAAKAALEEFSR

SEQ ID NO: 16577 - protein, 15 aa, Homo sapiens
VASAAAKAALEEFSR

SEQ ID NO: 16578 - protein, 16 aa, Homo sapiens
VREEVPLELVEAHVKK

SEQ ID NO: 16579 - protein, 16 aa, Homo sapiens
VREEVPLELVEAHVKK

SEQ ID NO: 16580 - protein, 16 aa, Homo sapiens
VREEVPLELVEAHVKK

SEQ ID NO: 16581 - protein, 15 aa, Homo sapiens
VASAAAKAALEEFSR

SEQ ID NO: 16582 - protein, 25 aa, Homo sapiens
KVEHEISEGNVATAAAAALASAATK

SEQ ID NO: 16583 - protein, 25 aa, Homo sapiens
KVEHEISEGNVATAAAAALASAATK

SEQ ID NO: 16584 - protein, 28 aa, Homo sapiens
TLAGLVVQLLQFQEDAFGKHVTNPAFTK

SEQ ID NO: 16585 - protein, 11 aa, Homo sapiens
HQGTFTDEKSK

SEQ ID NO: 16586 - protein, 11 aa, Homo sapiens
HQGTFTDEKSK

SEQ ID NO: 16587 - protein, 11 aa, Homo sapiens
HQGTFTDEKSK

SEQ ID NO: 16588 - protein, 18 aa, Homo sapiens
EKPVDLQNFGLRTDIYSK

SEQ ID NO: 16589 - protein, 18 aa, Homo sapiens
SPQVPAAQQMLNFPEKNK

SEQ ID NO: 16590 - protein, 18 aa, Homo sapiens
SPQVPAAQQMLNFPEKNK

SEQ ID NO: 16591 - protein, 18 aa, Homo sapiens
SPQVPAAQQMLNFPEKNK

SEQ ID NO: 16592 - protein, 18 aa, Homo sapiens
EKPVDLQNFGLRTDIYSK

SEQ ID NO: 16593 - protein, 18 aa, Homo sapiens
SPQVPAAQQMLNFPEKNK

SEQ ID NO: 16594 - protein, 12 aa, Homo sapiens
EKPVDLQNFGLR

SEQ ID NO: 16595 - protein, 18 aa, Homo sapiens
SPQVPAAQQMLNFPEKNK

SEQ ID NO: 16596 - protein, 18 aa, Homo sapiens
EKPVDLQNFGLRTDIYSK

SEQ ID NO: 16597 - protein, 12 aa, Homo sapiens
EKPVDLQNFGLR

SEQ ID NO: 16598 - protein, 18 aa, Homo sapiens
SPQVPAAQQMLNFPEKNK

SEQ ID NO: 16599 - protein, 18 aa, Homo sapiens
SPQVPAAQQMLNFPEKNK

SEQ ID NO: 16600 - protein, 12 aa, Homo sapiens
EKPVDLQNFGLR

SEQ ID NO: 16601 - protein, 12 aa, Homo sapiens
EKPVDLQNFGLR

SEQ ID NO: 16602 - protein, 12 aa, Homo sapiens
EKPVDLQNFGLR

SEQ ID NO: 16603 - protein, 12 aa, Homo sapiens
EKPVDLQNFGLR

SEQ ID NO: 16604 - protein, 12 aa, Homo sapiens
EKPVDLQNFGLR

SEQ ID NO: 16605 - protein, 12 aa, Homo sapiens
EKPVDLQNFGLR

SEQ ID NO: 16606 - protein, 12 aa, Homo sapiens
EKPVDLQNFGLR

SEQ ID NO: 16607 - protein, 12 aa, Homo sapiens
EKPVDLQNFGLR

SEQ ID NO: 16608 - protein, 18 aa, Homo sapiens
SPQVPAAQQMLNFPEKNK

SEQ ID NO: 16609 - protein, 12 aa, Homo sapiens
EKPVDLQNFGLR

SEQ ID NO: 16610 - protein, 12 aa, Homo sapiens
EKPVDLQNFGLR

SEQ ID NO: 16611 - protein, 12 aa, Homo sapiens
EKPVDLQNFGLR

SEQ ID NO: 16612 - protein, 12 aa, Homo sapiens
EKPVDLQNFGLR

SEQ ID NO: 16613 - protein, 12 aa, Homo sapiens
EKPVDLQNFGLR

SEQ ID NO: 16614 - protein, 12 aa, Homo sapiens
EKPVDLQNFGLR

SEQ ID NO: 16615 - protein, 12 aa, Homo sapiens
EKPVDLQNFGLR

SEQ ID NO: 16616 - protein, 18 aa, Homo sapiens
EKPVDLQNFGLRTDIYSK

SEQ ID NO: 16617 - protein, 12 aa, Homo sapiens
EKPVDLQNFGLR

SEQ ID NO: 16618 - protein, 18 aa, Homo sapiens
SPQVPAAQQMLNFPEKNK

SEQ ID NO: 16619 - protein, 18 aa, Homo sapiens
SPQVPAAQQMLNFPEKNK

SEQ ID NO: 16620 - protein, 12 aa, Homo sapiens
EKPVDLQNFGLR

SEQ ID NO: 16621 - protein, 12 aa, Homo sapiens
EKPVDLQNFGLR

SEQ ID NO: 16622 - protein, 12 aa, Homo sapiens
EKPVDLQNFGLR

SEQ ID NO: 16623 - protein, 12 aa, Homo sapiens
EKPVDLQNFGLR

SEQ ID NO: 16624 - protein, 18 aa, Homo sapiens
SPQVPAAQQMLNFPEKNK

SEQ ID NO: 16625 - protein, 18 aa, Homo sapiens
SPQVPAAQQMLNFPEKNK

SEQ ID NO: 16626 - protein, 18 aa, Homo sapiens
SPQVPAAQQMLNFPEKNK

SEQ ID NO: 16627 - protein, 7 aa, Homo sapiens
KVQEAAR

SEQ ID NO: 16628 - protein, 7 aa, Homo sapiens
KVQEAAR

SEQ ID NO: 16629 - protein, 25 aa, Homo sapiens
KVEHEISEGNVATAAAAALASAATK

SEQ ID NO: 16630 - protein, 14 aa, Homo sapiens
NVNLKKDSENTPVK

SEQ ID NO: 16631 - protein, 32 aa, Homo sapiens; identical to SEQ ID NO: 16574

SEQ ID NO: 16632 - protein, 8 aa, Homo sapiens
SKGASAGR

SEQ ID NO: 16633 - protein, 7 aa, Homo sapiens
TDIYSKK

SEQ ID NO: 16634 - protein, 7 aa, Homo sapiens
TDIYSKK

SEQ ID NO: 16635 - protein, 6 aa, Homo sapiens
TLAKSK

SEQ ID NO: 16636 - protein, 21 aa, Homo sapiens
SNSVGIQDAFNDGSDSTFQKR

SEQ ID NO: 16637 - protein, 21 aa, Homo sapiens
SNSVGIQDAFNDGSDSTFQKR

SEQ ID NO: 16638 - protein, 21 aa, Homo sapiens
SNSVGIQDAFNDGSDSTFQKR

SEQ ID NO: 16639 - protein, 21 aa, Homo sapiens
SNSVGIQDAFNDGSDSTFQKR

SEQ ID NO: 16640 - protein, 21 aa, Homo sapiens
SNSVGIQDAFNDGSDSTFQKR

SEQ ID NO: 16641 - protein, 25 aa, Homo sapiens
KAPGSDPFMSSGQGPNGGMGDPYSR

SEQ ID NO: 16642 - protein, 25 aa, Homo sapiens
KAPGSDPFMSSGQGPNGGMGDPYSR

SEQ ID NO: 16643 - protein, 25 aa, Homo sapiens
KAPGSDPFMSSGQGPNGGMGDPYSR

SEQ ID NO: 16644 - protein, 21 aa, Homo sapiens
SNSVGIQDAFNDGSDSTFQKR

SEQ ID NO: 16645 - protein, 29 aa, Homo sapiens
NIKILEDEPHSKDETPLCTLLDWQDSLAK

SEQ ID NO: 16646 - protein, 29 aa, Homo sapiens
NIKILEDEPHSKDETPLCTLLDWQDSLAK

SEQ ID NO: 16647 - protein, 29 aa, Homo sapiens
NIKILEDEPHSKDETPLCTLLDWQDSLAK

SEQ ID NO: 16648 - protein, 7 aa, Homo sapiens
FDKLPVK

SEQ ID NO: 16649 - protein, 15 aa, Homo sapiens
DKPASENSEEKLISK

SEQ ID NO: 16650 - protein, 15 aa, Homo sapiens
DKPASENSEEKLISK

SEQ ID NO: 16651 - protein, 15 aa, Homo sapiens
DKPASENSEEKLISK

SEQ ID NO: 16652 - protein, 25 aa, Homo sapiens
KAPGSDPFMSSGQGPNGGMGDPYSR

SEQ ID NO: 16653 - protein, 25 aa, Homo sapiens
KAPGSDPFMSSGQGPNGGMGDPYSR

SEQ ID NO: 16654 - protein, 14 aa, Homo sapiens
MSYEPNKDPYGSMR

SEQ ID NO: 16655 - protein, 25 aa, Homo sapiens
KAPGSDPFMSSGQGPNGGMGDPYSR

SEQ ID NO: 16656 - protein, 14 aa, Homo sapiens
MSYEPNKDPYGSMR

SEQ ID NO: 16657 - protein, 14 aa, Homo sapiens
MSYEPNKDPYGSMR

SEQ ID NO: 16658 - protein, 14 aa, Homo sapiens
MSYEPNKDPYGSMR

SEQ ID NO: 16659 - protein, 25 aa, Homo sapiens
KAPGSDPFMSSGQGPNGGMGDPYSR

SEQ ID NO: 16660 - protein, 25 aa, Homo sapiens
KAPGSDPFMSSGQGPNGGMGDPYSR

SEQ ID NO: 16661 - protein, 14 aa, Homo sapiens
MSYEPNKDPYGSMR

SEQ ID NO: 16662 - protein, 14 aa, Homo sapiens
MSYEPNKDPYGSMR

SEQ ID NO: 16663 - protein, 14 aa, Homo sapiens
MSYEPNKDPYGSMR

SEQ ID NO: 16664 - protein, 14 aa, Homo sapiens
MSYEPNKDPYGSMR

SEQ ID NO: 16665 - protein, 25 aa, Homo sapiens
KAPGSDPFMSSGQGPNGGMGDPYSR

SEQ ID NO: 16666 - protein, 14 aa, Homo sapiens
MSYEPNKDPYGSMR

SEQ ID NO: 16667 - protein, 14 aa, Homo sapiens
MSYEPNKDPYGSMR

SEQ ID NO: 16668 - protein, 14 aa, Homo sapiens
MSYEPNKDPYGSMR

SEQ ID NO: 16669 - protein, 14 aa, Homo sapiens
MSYEPNKDPYGSMR

SEQ ID NO: 16670 - protein, 14 aa, Homo sapiens
MSYEPNKDPYGSMR

SEQ ID NO: 16671 - protein, 14 aa, Homo sapiens
MSYEPNKDPYGSMR

SEQ ID NO: 16672 - protein, 25 aa, Homo sapiens
KAPGSDPFMSSGQGPNGGMGDPYSR

SEQ ID NO: 16673 - protein, 14 aa, Homo sapiens
MSYEPNKDPYGSMR

SEQ ID NO: 16674 - protein, 16 aa, Homo sapiens
SSTLTEDGAKSSEAIK

SEQ ID NO: 16675 - protein, 16 aa, Homo sapiens
SSTLTEDGAKSSEAIK

SEQ ID NO: 16676 - protein, 16 aa, Homo sapiens
SSTLTEDGAKSSEAIK

SEQ ID NO: 16677 - protein, 16 aa, Homo sapiens
SSTLTEDGAKSSEAIK

SEQ ID NO: 16678 - protein, 12 aa, Homo sapiens
LILLHHKHPERK

SEQ ID NO: 16679 - protein, 27 aa, Homo sapiens
KHVTTAEGTPGTTDQEGPPPDGPPEKR

SEQ ID NO: 16680 - protein, 14 aa, Homo sapiens
ITKLYELGGEPERK

SEQ ID NO: 16681 - protein, 13 aa, Homo sapiens
ITKLYELGGEPER

SEQ ID NO: 16682 - protein, 13 aa, Homo sapiens
ITKLYELGGEPER

SEQ ID NO: 16683 - protein, 13 aa, Homo sapiens
ITKLYELGGEPER

SEQ ID NO: 16684 - protein, 14 aa, Homo sapiens
MSYEPNKDPYGSMR

SEQ ID NO: 16685 - protein, 11 aa, Homo sapiens
KSSSSTTTNEK

SEQ ID NO: 16686 - protein, 21 aa, Homo sapiens
SNSVGIQDAFNDGSDSTFQKR

SEQ ID NO: 16687 - protein, 21 aa, Homo sapiens
SNSVGIQDAFNDGSDSTFQKR

SEQ ID NO: 16688 - protein, 21 aa, Homo sapiens
SNSVGIQDAFNDGSDSTFQKR

SEQ ID NO: 16689 - protein, 24 aa, Homo sapiens
GEMKAAAGQESEGPAVGPPQPLGK

SEQ ID NO: 16690 - protein, 10 aa, Homo sapiens
LEKLYSTMVR

SEQ ID NO: 16691 - protein, 10 aa, Homo sapiens
LEKLYSTMVR

SEQ ID NO: 16692 - protein, 6 aa, Homo sapiens
KNPVCR

SEQ ID NO: 16693 - protein, 5 aa, Homo sapiens
IKLGR

SEQ ID NO: 16694 - protein, 15 aa, Homo sapiens
IVDAVIKYKDSSSGR

SEQ ID NO: 16695 - protein, 16 aa, Homo sapiens
KRDSDAGSSTPTTSTR

SEQ ID NO: 16696 - protein, 16 aa, Homo sapiens
KRDSDAGSSTPTTSTR

SEQ ID NO: 16697 - protein, 16 aa, Homo sapiens
KRDSDAGSSTPTTSTR

SEQ ID NO: 16698 - protein, 16 aa, Homo sapiens
KRDSDAGSSTPTTSTR

SEQ ID NO: 16699 - protein, 16 aa, Homo sapiens
KRDSDAGSSTPTTSTR

SEQ ID NO: 16700 - protein, 16 aa, Homo sapiens
KRDSDAGSSTPTTSTR

SEQ ID NO: 16701 - protein, 16 aa, Homo sapiens
KRDSDAGSSTPTTSTR

SEQ ID NO: 16702 - protein, 16 aa, Homo sapiens
KRDSDAGSSTPTTSTR

SEQ ID NO: 16703 - protein, 16 aa, Homo sapiens
KRDSDAGSSTPTTSTR

SEQ ID NO: 16704 - protein, 16 aa, Homo sapiens
KRDSDAGSSTPTTSTR

SEQ ID NO: 16705 - protein, 16 aa, Homo sapiens
VIQAGMFDQKSSSHER

SEQ ID NO: 16706 - protein, 16 aa, Homo sapiens
VIQAGMFDQKSSSHER

SEQ ID NO: 16707 - protein, 5 aa, Homo sapiens
IEKER

SEQ ID NO: 16708 - protein, 15 aa, Homo sapiens
AVATYHANTEREQKK

SEQ ID NO: 16709 - protein, 15 aa, Homo sapiens
AVATYHANTEREQKK

SEQ ID NO: 16710 - protein, 15 aa, Homo sapiens
AVATYHANTEREQKK

SEQ ID NO: 16711 - protein, 15 aa, Homo sapiens
AVATYHANTEREQKK

SEQ ID NO: 16712 - protein, 15 aa, Homo sapiens
AVATYHANTEREQKK

SEQ ID NO: 16713 - protein, 15 aa, Homo sapiens
AVATYHANTEREQKK

SEQ ID NO: 16714 - protein, 9 aa, Homo sapiens
ENERIEKER

SEQ ID NO: 16715 - protein, 15 aa, Homo sapiens
AVATYHANTEREQKK

SEQ ID NO: 16716 - protein, 15 aa, Homo sapiens
AVATYHANTEREQKK

SEQ ID NO: 16717 - protein, 15 aa, Homo sapiens
AVATYHANTEREQKK

SEQ ID NO: 16718 - protein, 15 aa, Homo sapiens
AVATYHANTEREQKK

SEQ ID NO: 16719 - protein, 6 aa, Homo sapiens
LIDQKK

SEQ ID NO: 16720 - protein, 17 aa, Homo sapiens
GRPPAEKLSPNPPNLTK

SEQ ID NO: 16721 - protein, 7 aa, Homo sapiens
KEKAQDR

SEQ ID NO: 16722 - protein, 15 aa, Homo sapiens
IVDAVIKYKDSSSGR

SEQ ID NO: 16723 - protein, 22 aa, Homo sapiens
HIIENAKQDVDDEYGVSQALAR

SEQ ID NO: 16724 - protein, 22 aa, Homo sapiens
HIIENAKQDVDDEYGVSQALAR

SEQ ID NO: 16725 - protein, 4 aa, Homo sapiens
KDKR

SEQ ID NO: 16726 - protein, 4 aa, Homo sapiens
KDKR

SEQ ID NO: 16727 - protein, 4 aa, Homo sapiens
KDKR

SEQ ID NO: 16728 - protein, 16 aa, Homo sapiens
LMAEDEEGYRKLIDQK

SEQ ID NO: 16729 - protein, 4 aa, Homo sapiens
KDKR

SEQ ID NO: 16730 - protein, 4 aa, Homo sapiens
VKIK

SEQ ID NO: 16731 - protein, 4 aa, Homo sapiens
VKIK

SEQ ID NO: 16732 - protein, 16 aa, Homo sapiens
GQPLPDHLQMAVQGKR

SEQ ID NO: 16733 - protein, 6 aa, Homo sapiens
LIDQKK

SEQ ID NO: 16734 - protein, 5 aa, Homo sapiens
NHKYR

SEQ ID NO: 16735 - protein, 7 aa, Homo sapiens
IRNHKYR

SEQ ID NO: 16736 - protein, 6 aa, Homo sapiens
KPVDFK

SEQ ID NO: 16737 - protein, 16 aa, Homo sapiens
KRDSDAGSSTPTTSTR

SEQ ID NO: 16738 - protein, 16 aa, Homo sapiens
KRDSDAGSSTPTTSTR

SEQ ID NO: 16739 - protein, 16 aa, Homo sapiens
KRDSDAGSSTPTTSTR

SEQ ID NO: 16740 - protein, 16 aa, Homo sapiens
KRDSDAGSSTPTTSTR

SEQ ID NO: 16741 - protein, 16 aa, Homo sapiens
KRDSDAGSSTPTTSTR

SEQ ID NO: 16742 - protein, 16 aa, Homo sapiens
KRDSDAGSSTPTTSTR

SEQ ID NO: 16743 - protein, 16 aa, Homo sapiens
KRDSDAGSSTPTTSTR

SEQ ID NO: 16744 - protein, 16 aa, Homo sapiens
KRDSDAGSSTPTTSTR

SEQ ID NO: 16745 - protein, 14 aa, Homo sapiens
HRKEVDYSDSLTEK

SEQ ID NO: 16746 - protein, 13 aa, Homo sapiens
YLRLDGTTKAEDR

SEQ ID NO: 16747 - protein, 15 aa, Homo sapiens
LDGTTKAEDRGMLLK

SEQ ID NO: 16748 - protein, 15 aa, Homo sapiens
LDGTTKAEDRGMLLK

SEQ ID NO: 16749 - protein, 15 aa, Homo sapiens
LDGTTKAEDRGMLLK

SEQ ID NO: 16750 - protein, 10 aa, Homo sapiens
LDGTTKAEDR

SEQ ID NO: 16751 - protein, 13 aa, Homo sapiens
YLRLDGTTKAEDR

SEQ ID NO: 16752 - protein, 10 aa, Homo sapiens
LDGTTKAEDR

SEQ ID NO: 16753 - protein, 7 aa, Homo sapiens
ITEKLEK

SEQ ID NO: 16754 - protein, 8 aa, Homo sapiens
QQKIEQER

SEQ ID NO: 16755 - protein, 20 aa, Homo sapiens
LMEEDELPSWIIKDDAEVER

SEQ ID NO: 16756 - protein, 20 aa, Homo sapiens
LMEEDELPSWIIKDDAEVER

SEQ ID NO: 16757 - protein, 20 aa, Homo sapiens
LMEEDELPSWIIKDDAEVER

SEQ ID NO: 16758 - protein, 20 aa, Homo sapiens
LMEEDELPSWIIKDDAEVER

SEQ ID NO: 16759 - protein, 6 aa, Homo sapiens
LGRKEK

SEQ ID NO: 16760 - protein, 5 aa, Homo sapiens
LKGGR

SEQ ID NO: 16761 - protein, 5 aa, Homo sapiens
LKGGR

SEQ ID NO: 16762 - protein, 14 aa, Homo sapiens
LTKAVATYHANTER

SEQ ID NO: 16763 - protein, 8 aa, Homo sapiens
SVTGKIQK

SEQ ID NO: 16764 - protein, 7 aa, Homo sapiens
KEKAQDR

SEQ ID NO: 16765 - protein, 7 aa, Homo sapiens
KEKAQDR

SEQ ID NO: 16766 - protein, 5 aa, Homo sapiens
IKLGR

SEQ ID NO: 16767 - protein, 5 aa, Homo sapiens
IKLGR

SEQ ID NO: 16768 - protein, 5 aa, Homo sapiens
IKLGR

SEQ ID NO: 16769 - protein, 5 aa, Homo sapiens
IKLGR

SEQ ID NO: 16770 - protein, 7 aa, Homo sapiens
KEKAQDR

SEQ ID NO: 16771 - protein, 7 aa, Homo sapiens
KEKAQDR

SEQ ID NO: 16772 - protein, 5 aa, Homo sapiens
IKLGR

SEQ ID NO: 16773 - protein, 5 aa, Homo sapiens
LKGGR

SEQ ID NO: 16774 - protein, 10 aa, Homo sapiens
VSYKGSPAAR

SEQ ID NO: 16775 - protein, 5 aa, Homo sapiens
NHKYR

SEQ ID NO: 16776 - protein, 5 aa, Homo sapiens
LKGGR

SEQ ID NO: 16777 - protein, 7 aa, Homo sapiens
IRNHKYR

SEQ ID NO: 16778 - protein, 22 aa, Homo sapiens
HIIENAKQDVDDEYGVSQALAR

SEQ ID NO: 16779 - protein, 10 aa, Homo sapiens
LDGTTKAEDR

SEQ ID NO: 16780 - protein, 16 aa, Homo sapiens
KRDSDAGSSTPTTSTR

SEQ ID NO: 16781 - protein, 5 aa, Homo sapiens
LKGGR

SEQ ID NO: 16782 - protein, 10 aa, Homo sapiens
VSYKGSPAAR

SEQ ID NO: 16783 - protein, 16 aa, Homo sapiens
LCTVNSVEEKILAAAK

SEQ ID NO: 16784 - protein, 6 aa, Homo sapiens
ILPKLR

SEQ ID NO: 16785 - protein, 16 aa, Homo sapiens
VIQAGMFDQKSSSHER

SEQ ID NO: 16786 - protein, 16 aa, Homo sapiens
VIQAGMFDQKSSSHER

SEQ ID NO: 16787 - protein, 16 aa, Homo sapiens
VIQAGMFDQKSSSHER

SEQ ID NO: 16788 - protein, 23 aa, Homo sapiens
AGYAGEDCPKVDFPTAIGMVVER

SEQ ID NO: 16789 - protein, 23 aa, Homo sapiens
AGYAGEDCPKVDFPTAIGMVVER

SEQ ID NO: 16790 - protein, 29 aa, Homo sapiens
DDGSTLMEIDGDKGKQGGPTYYIDTNALR

SEQ ID NO: 16791 - protein, 36 aa, Homo sapiens; identical to SEQ ID NO: 9086

SEQ ID NO: 16792 - protein, 29 aa, Homo sapiens
DDGSTLMEIDGDKGKQGGPTYYIDTNALR

SEQ ID NO: 16793 - protein, 36 aa, Homo sapiens; identical to SEQ ID NO: 9086

SEQ ID NO: 16794 - protein, 29 aa, Homo sapiens
DDGSTLMEIDGDKGKQGGPTYYIDTNALR

SEQ ID NO: 16795 - protein, 23 aa, Homo sapiens
AGYAGEDCPKVDFPTAIGMVVER

SEQ ID NO: 16796 - protein, 23 aa, Homo sapiens
AGYAGEDCPKVDFPTAIGMVVER

SEQ ID NO: 16797 - protein, 23 aa, Homo sapiens
AGYAGEDCPKVDFPTAIGMVVER

SEQ ID NO: 16798 - protein, 29 aa, Homo sapiens
DDGSTLMEIDGDKGKQGGPTYYIDTNALR

SEQ ID NO: 16799 - protein, 36 aa, Homo sapiens; identical to SEQ ID NO: 9086

SEQ ID NO: 16800 - protein, 29 aa, Homo sapiens
DDGSTLMEIDGDKGKQGGPTYYIDTNALR

SEQ ID NO: 16801 - protein, 36 aa, Homo sapiens; identical to SEQ ID NO: 9086

SEQ ID NO: 16802 - protein, 36 aa, Homo sapiens; identical to SEQ ID NO: 9086

SEQ ID NO: 16803 - protein, 36 aa, Homo sapiens; identical to SEQ ID NO: 9086

SEQ ID NO: 16804 - protein, 29 aa, Homo sapiens
DDGSTLMEIDGDKGKQGGPTYYIDTNALR

SEQ ID NO: 16805 - protein, 29 aa, Homo sapiens
DDGSTLMEIDGDKGKQGGPTYYIDTNALR

SEQ ID NO: 16806 - protein, 29 aa, Homo sapiens
DDGSTLMEIDGDKGKQGGPTYYIDTNALR

SEQ ID NO: 16807 - protein, 29 aa, Homo sapiens
DDGSTLMEIDGDKGKQGGPTYYIDTNALR

SEQ ID NO: 16808 - protein, 23 aa, Homo sapiens
AGYAGEDCPKVDFPTAIGMVVER

SEQ ID NO: 16809 - protein, 23 aa, Homo sapiens
AGYAGEDCPKVDFPTAIGMVVER

SEQ ID NO: 16810 - protein, 29 aa, Homo sapiens
DDGSTLMEIDGDKGKQGGPTYYIDTNALR

SEQ ID NO: 16811 - protein, 23 aa, Homo sapiens
AGYAGEDCPKVDFPTAIGMVVER

SEQ ID NO: 16812 - protein, 29 aa, Homo sapiens
DDGSTLMEIDGDKGKQGGPTYYIDTNALR

SEQ ID NO: 16813 - protein, 29 aa, Homo sapiens
DDGSTLMEIDGDKGKQGGPTYYIDTNALR

SEQ ID NO: 16814 - protein, 29 aa, Homo sapiens
DDGSTLMEIDGDKGKQGGPTYYIDTNALR

SEQ ID NO: 16815 - protein, 23 aa, Homo sapiens
AGYAGEDCPKVDFPTAIGMVVER

SEQ ID NO: 16816 - protein, 23 aa, Homo sapiens
AGYAGEDCPKVDFPTAIGMVVER

SEQ ID NO: 16817 - protein, 29 aa, Homo sapiens
DDGSTLMEIDGDKGKQGGPTYYIDTNALR

SEQ ID NO: 16818 - protein, 23 aa, Homo sapiens
AGYAGEDCPKVDFPTAIGMVVER

SEQ ID NO: 16819 - protein, 23 aa, Homo sapiens
AGYAGEDCPKVDFPTAIGMVVER

SEQ ID NO: 16820 - protein, 9 aa, Homo sapiens
KEKLPQVTR

SEQ ID NO: 16821 - protein, 13 aa, Homo sapiens
EAVREGSPANWKR

SEQ ID NO: 16822 - protein, 9 aa, Homo sapiens
KEKLPQVTR

SEQ ID NO: 16823 - protein, 9 aa, Homo sapiens
EGSPANWKR

SEQ ID NO: 16824 - protein, 9 aa, Homo sapiens
EGSPANWKR

SEQ ID NO: 16825 - protein, 9 aa, Homo sapiens
KEKLPQVTR

SEQ ID NO: 16826 - protein, 9 aa, Homo sapiens
KEKLPQVTR

SEQ ID NO: 16827 - protein, 9 aa, Homo sapiens
KEKLPQVTR

SEQ ID NO: 16828 - protein, 9 aa, Homo sapiens
EGSPANWKR

SEQ ID NO: 16829 - protein, 9 aa, Homo sapiens
EGSPANWKR

SEQ ID NO: 16830 - protein, 9 aa, Homo sapiens
KEKLPQVTR

SEQ ID NO: 16831 - protein, 9 aa, Homo sapiens
EGSPANWKR

SEQ ID NO: 16832 - protein, 9 aa, Homo sapiens
EGSPANWKR

SEQ ID NO: 16833 - protein, 9 aa, Homo sapiens
EGSPANWKR

SEQ ID NO: 16834 - protein, 9 aa, Homo sapiens
KEKLPQVTR

SEQ ID NO: 16835 - protein, 9 aa, Homo sapiens
KEKLPQVTR

SEQ ID NO: 16836 - protein, 9 aa, Homo sapiens
KEKLPQVTR

SEQ ID NO: 16837 - protein, 9 aa, Homo sapiens
KEKLPQVTR

SEQ ID NO: 16838 - protein, 9 aa, Homo sapiens
KEKLPQVTR

SEQ ID NO: 16839 - protein, 9 aa, Homo sapiens
EGSPANWKR

SEQ ID NO: 16840 - protein, 9 aa, Homo sapiens
KEKLPQVTR

SEQ ID NO: 16841 - protein, 13 aa, Homo sapiens
EAVREGSPANWKR

SEQ ID NO: 16842 - protein, 9 aa, Homo sapiens
EGSPANWKR

SEQ ID NO: 16843 - protein, 9 aa, Homo sapiens
EGSPANWKR

SEQ ID NO: 16844 - protein, 9 aa, Homo sapiens
EGSPANWKR

SEQ ID NO: 16845 - protein, 13 aa, Homo sapiens
EAVREGSPANWKR

SEQ ID NO: 16846 - protein, 13 aa, Homo sapiens
EAVREGSPANWKR

SEQ ID NO: 16847 - protein, 9 aa, Homo sapiens
EGSPANWKR

SEQ ID NO: 16848 - protein, 13 aa, Homo sapiens
QEYEEGGKQCVER

SEQ ID NO: 16849 - protein, 13 aa, Homo sapiens
QEYEEGGKQCVER

SEQ ID NO: 16850 - protein, 13 aa, Homo sapiens
QEYEEGGKQCVER

SEQ ID NO: 16851 - protein, 20 aa, Homo sapiens
EKLTELMFEHYNIPAFFLCK

SEQ ID NO: 16852 - protein, 13 aa, Homo sapiens
QEYEEGGKQCVER

SEQ ID NO: 16853 - protein, 9 aa, Homo sapiens
KEKLPQVTR

SEQ ID NO: 16854 - protein, 23 aa, Homo sapiens
ELFQEMNIELVPPYMIASKEAVR

SEQ ID NO: 16855 - protein, 23 aa, Homo sapiens
ELFQEMNIELVPPYMIASKEAVR

SEQ ID NO: 16856 - protein, 23 aa, Homo sapiens
ELFQEMNIELVPPYMIASKEAVR

SEQ ID NO: 16857 - protein, 23 aa, Homo sapiens
ELFQEMNIELVPPYMIASKEAVR

SEQ ID NO: 16858 - protein, 9 aa, Homo sapiens
KEKLPQVTR

SEQ ID NO: 16859 - protein, 23 aa, Homo sapiens
ELFQEMNIELVPPYMIASKEAVR

SEQ ID NO: 16860 - protein, 23 aa, Homo sapiens
ELFQEMNIELVPPYMIASKEAVR

SEQ ID NO: 16861 - protein, 12 aa, Homo sapiens
LKLIANNTTVER

SEQ ID NO: 16862 - protein, 13 aa, Homo sapiens
LKLIANNTTVERR

SEQ ID NO: 16863 - protein, 6 aa, Homo sapiens
GSLYKR

SEQ ID NO: 16864 - protein, 15 aa, Homo sapiens
KAIVICPTDEDLKDR

SEQ ID NO: 16865 - protein, 15 aa, Homo sapiens
KAIVICPTDEDLKDR

SEQ ID NO: 16866 - protein, 15 aa, Homo sapiens
KAIVICPTDEDLKDR

SEQ ID NO: 16867 - protein, 15 aa, Homo sapiens
KAIVICPTDEDLKDR

SEQ ID NO: 16868 - protein, 8 aa, Homo sapiens
GTVGPKSK

SEQ ID NO: 16869 - protein, 19 aa, Homo sapiens
QGAPTSFLPPEASQLKPDR

SEQ ID NO: 16870 - protein, 21 aa, Homo sapiens
INEEISVKHLPSTEPDPHVVR

SEQ ID NO: 16871 - protein, 21 aa, Homo sapiens
INEEISVKHLPSTEPDPHVVR

SEQ ID NO: 16872 - protein, 21 aa, Homo sapiens
INEEISVKHLPSTEPDPHVVR

SEQ ID NO: 16873 - protein, 6 aa, Homo sapiens
KSTNSR

SEQ ID NO: 16874 - protein, 21 aa, Homo sapiens
INEEISVKHLPSTEPDPHVVR

SEQ ID NO: 16875 - protein, 20 aa, Homo sapiens
QNQFYDTQVIKQENESGYER

SEQ ID NO: 16876 - protein, 8 aa, Homo sapiens
KRPYEENR

SEQ ID NO: 16877 - protein, 19 aa, Homo sapiens
PLEMEQQQAYRPEMKTEMK

SEQ ID NO: 16878 - protein, 14 aa, Homo sapiens
AIVICPTDEDLKDR

SEQ ID NO: 16879 - protein, 15 aa, Homo sapiens
TTWAIKHAASNPSKK

SEQ ID NO: 16880 - protein, 13 aa, Homo sapiens
KYNILGTNAIMDK

SEQ ID NO: 16881 - protein, 12 aa, Homo sapiens
LKVNELREELQR

SEQ ID NO: 16882 - protein, 12 aa, Homo sapiens
LKVNELREELQR

SEQ ID NO: 16883 - protein, 12 aa, Homo sapiens
LKVNELREELQR

SEQ ID NO: 16884 - protein, 8 aa, Homo sapiens
KRPYEENR

SEQ ID NO: 16885 - protein, 8 aa, Homo sapiens
KRPYEENR

SEQ ID NO: 16886 - protein, 8 aa, Homo sapiens
KRPYEENR

SEQ ID NO: 16887 - protein, 21 aa, Homo sapiens
INEEISVKHLPSTEPDPHVVR

SEQ ID NO: 16888 - protein, 21 aa, Homo sapiens
INEEISVKHLPSTEPDPHVVR

SEQ ID NO: 16889 - protein, 3 aa, Homo sapiens
KKR

SEQ ID NO: 16890 - protein, 26 aa, Homo sapiens
LTALLLPPDPIVINHVISVDPSDQKK

SEQ ID NO: 16891 - protein, 27 aa, Homo sapiens
LYISNTFNPAKPDAEDSDGSIASWELR

SEQ ID NO: 16892 - protein, 27 aa, Homo sapiens
LYISNTFNPAKPDAEDSDGSIASWELR

SEQ ID NO: 16893 - protein, 7 aa, Homo sapiens
KLIDQKK

SEQ ID NO: 16894 - protein, 5 aa, Homo sapiens
IEKER

SEQ ID NO: 16895 - protein, 4 aa, Homo sapiens
KDRR

SEQ ID NO: 16896 - protein, 8 aa, Homo sapiens
SRAKDDIK

SEQ ID NO: 16897 - protein, 8 aa, Homo sapiens
KVMATIEK

SEQ ID NO: 16898 - protein, 6 aa, Homo sapiens
AKDDIK

SEQ ID NO: 16899 - protein, 9 aa, Homo sapiens
VMATIEKVR

SEQ ID NO: 16900 - protein, 11 aa, Homo sapiens
QASKFDKLPIK

SEQ ID NO: 16901 - protein, 11 aa, Homo sapiens
QASKFDKLPIK

SEQ ID NO: 16902 - protein, 11 aa, Homo sapiens
QASKFDKLPIK

SEQ ID NO: 16903 - protein, 10 aa, Homo sapiens
FDKLPIKIVK

SEQ ID NO: 16904 - protein, 10 aa, Homo sapiens
FDKLPIKIVK

SEQ ID NO: 16905 - protein, 10 aa, Homo sapiens
QEKFYATLVR

SEQ ID NO: 16906 - protein, 10 aa, Homo sapiens
QEKFYATLVR

SEQ ID NO: 16907 - protein, 10 aa, Homo sapiens
QEKFYATLVR

SEQ ID NO: 16908 - protein, 21 aa, Homo sapiens
SSTISVHDPFSDVSDSSFPKR

SEQ ID NO: 16909 - protein, 21 aa, Homo sapiens
SSTISVHDPFSDVSDSSFPKR

SEQ ID NO: 16910 - protein, 21 aa, Homo sapiens
SSTISVHDPFSDVSDSSFPKR

SEQ ID NO: 16911 - protein, 20 aa, Homo sapiens
KAQEAAAAVMQAAANSAQSR

SEQ ID NO: 16912 - protein, 20 aa, Homo sapiens
KAQEAAAAVMQAAANSAQSR

SEQ ID NO: 16913 - protein, 40 aa, Homo sapiens
KVPGSSEPFMTQGQMPNSSMQDMYNQSPSGAMSNLGMGQR

SEQ ID NO: 16914 - protein, 40 aa, Homo sapiens; identical to SEQ ID NO: 16913

SEQ ID NO: 16915 - protein, 27 aa, Homo sapiens
AEGDSAGTAGTPGGTPAGDKVASWELR

SEQ ID NO: 16916 - protein, 38 aa, Homo sapiens; identical to SEQ ID NO: 8179

SEQ ID NO: 16917 - protein, 27 aa, Homo sapiens
AEGDSAGTAGTPGGTPAGDKVASWELR

SEQ ID NO: 16918 - protein, 38 aa, Homo sapiens; identical to SEQ ID NO: 8179

SEQ ID NO: 16919 - protein, 22 aa, Homo sapiens
PGDLNVKCTLLLMLDHQPPQYK

SEQ ID NO: 16920 - protein, 22 aa, Homo sapiens
PGDLNVKCTLLLMLDHQPPQYK

SEQ ID NO: 16921 - protein, 22 aa, Homo sapiens
PGDLNVKCTLLLMLDHQPPQYK

SEQ ID NO: 16922 - protein, 22 aa, Homo sapiens
PGDLNVKCTLLLMLDHQPPQYK

SEQ ID NO: 16923 - protein, 23 aa, Homo sapiens
RPGDLNVKCTLLLMLDHQPPQYK

SEQ ID NO: 16924 - protein, 23 aa, Homo sapiens
RPGDLNVKCTLLLMLDHQPPQYK

SEQ ID NO: 16925 - protein, 38 aa, Homo sapiens; identical to SEQ ID NO: 8179

SEQ ID NO: 16926 - protein, 38 aa, Homo sapiens; identical to SEQ ID NO: 8179

SEQ ID NO: 16927 - protein, 38 aa, Homo sapiens; identical to SEQ ID NO: 8179

SEQ ID NO: 16928 - protein, 38 aa, Homo sapiens; identical to SEQ ID NO: 8179

SEQ ID NO: 16929 - protein, 38 aa, Homo sapiens; identical to SEQ ID NO: 8179

SEQ ID NO: 16930 - protein, 31 aa, Homo sapiens; identical to SEQ ID NO: 8182

SEQ ID NO: 16931 - protein, 21 aa, Homo sapiens
MPTTQETDGFQVKRPGDLNVK

SEQ ID NO: 16932 - protein, 31 aa, Homo sapiens; identical to SEQ ID NO: 8182

SEQ ID NO: 16933 - protein, 38 aa, Homo sapiens; identical to SEQ ID NO: 8179

SEQ ID NO: 16934 - protein, 31 aa, Homo sapiens; identical to SEQ ID NO: 8182

SEQ ID NO: 16935 - protein, 31 aa, Homo sapiens; identical to SEQ ID NO: 8182

SEQ ID NO: 16936 - protein, 10 aa, Homo sapiens
RMEIQEAIKK

SEQ ID NO: 16937 - protein, 9 aa, Homo sapiens
MEIQEAIKK

SEQ ID NO: 16938 - protein, 9 aa, Homo sapiens
MEIQEAIKK

SEQ ID NO: 16939 - protein, 26 aa, Homo sapiens
LAGLLQHPDPIVINHVISVDPNDQKK

SEQ ID NO: 16940 - protein, 26 aa, Homo sapiens
LAGLLQHPDPIVINHVISVDPNDQKK

SEQ ID NO: 16941 - protein, 25 aa, Homo sapiens
LCGLKVEVDMEKIAAEIAQAEEQAR

SEQ ID NO: 16942 - protein, 14 aa, Homo sapiens
FLESTDSFNNELKR

SEQ ID NO: 16943 - protein, 25 aa, Homo sapiens
LCGLKVEVDMEKIAAEIAQAEEQAR

SEQ ID NO: 16944 - protein, 25 aa, Homo sapiens
LCGLKVEVDMEKIAAEIAQAEEQAR

SEQ ID NO: 16945 - protein, 14 aa, Homo sapiens
FLESTDSFNNELKR

SEQ ID NO: 16946 - protein, 25 aa, Homo sapiens
LCGLKVEVDMEKIAAEIAQAEEQAR

SEQ ID NO: 16947 - protein, 25 aa, Homo sapiens
LCGLKVEVDMEKIAAEIAQAEEQAR

SEQ ID NO: 16948 - protein, 25 aa, Homo sapiens
LCGLKVEVDMEKIAAEIAQAEEQAR

SEQ ID NO: 16949 - protein, 14 aa, Homo sapiens
FLESTDSFNNELKR

SEQ ID NO: 16950 - protein, 25 aa, Homo sapiens
LCGLKVEVDMEKIAAEIAQAEEQAR

SEQ ID NO: 16951 - protein, 25 aa, Homo sapiens
LCGLKVEVDMEKIAAEIAQAEEQAR

SEQ ID NO: 16952 - protein, 25 aa, Homo sapiens
LCGLKVEVDMEKIAAEIAQAEEQAR

SEQ ID NO: 16953 - protein, 25 aa, Homo sapiens
LCGLKVEVDMEKIAAEIAQAEEQAR

SEQ ID NO: 16954 - protein, 15 aa, Homo sapiens
KFLESTDSFNNELKR

SEQ ID NO: 16955 - protein, 10 aa, Homo sapiens
EKEAAEQAER

SEQ ID NO: 16956 - protein, 24 aa, Homo sapiens
KGPDGLALPNNYCDFCLGDSKINK

SEQ ID NO: 16957 - protein, 24 aa, Homo sapiens
KGPDGLALPNNYCDFCLGDSKINK

SEQ ID NO: 16958 - protein, 8 aa, Homo sapiens
GKGVGSAR

SEQ ID NO: 16959 - protein, 21 aa, Homo sapiens
SGHPSCLQFTPVMMAAVKTYR

SEQ ID NO: 16960 - protein, 21 aa, Homo sapiens
SGHPSCLQFTPVMMAAVKTYR

SEQ ID NO: 16961 - protein, 21 aa, Homo sapiens
SGHPSCLQFTPVMMAAVKTYR

SEQ ID NO: 16962 - protein, 19 aa, Homo sapiens
INKKTGQPEELVSCSDCGR

SEQ ID NO: 16963 - protein, 24 aa, Homo sapiens
KGPDGLALPNNYCDFCLGDSKINK

SEQ ID NO: 16964 - protein, 24 aa, Homo sapiens
KGPDGLALPNNYCDFCLGDSKINK

SEQ ID NO: 16965 - protein, 21 aa, Homo sapiens
KGPDGLALPNNYCDFCLGDSK

SEQ ID NO: 16966 - protein, 7 aa, Homo sapiens
SEEQKSK

SEQ ID NO: 16967 - protein, 21 aa, Homo sapiens
KGPDGLALPNNYCDFCLGDSK

SEQ ID NO: 16968 - protein, 7 aa, Homo sapiens
SEEQKSK

SEQ ID NO: 16969 - protein, 7 aa, Homo sapiens
SEEQKSK

SEQ ID NO: 16970 - protein, 7 aa, Homo sapiens
SEEQKSK

SEQ ID NO: 16971 - protein, 7 aa, Homo sapiens
TDPLEKR

SEQ ID NO: 16972 - protein, 17 aa, Homo sapiens
KEGLISQDGSSLEALLR

SEQ ID NO: 16973 - protein, 17 aa, Homo sapiens
KEGLISQDGSSLEALLR

SEQ ID NO: 16974 - protein, 7 aa, Homo sapiens
TDPLEKR

SEQ ID NO: 16975 - protein, 17 aa, Homo sapiens
KEGLISQDGSSLEALLR

SEQ ID NO: 16976 - protein, 24 aa, Homo sapiens
ILEPDDFLDDLDDEDYEEDTPKRR

SEQ ID NO: 16977 - protein, 23 aa, Homo sapiens
ILEPDDFLDDLDDEDYEEDTPKR

SEQ ID NO: 16978 - protein, 23 aa, Homo sapiens
ILEPDDFLDDLDDEDYEEDTPKR

SEQ ID NO: 16979 - protein, 17 aa, Homo sapiens
KVVDDLLDQITGGDHSR

SEQ ID NO: 16980 - protein, 17 aa, Homo sapiens
KVVDDLLDQITGGDHSR

SEQ ID NO: 16981 - protein, 8 aa, Homo sapiens
TLFQLKQR

SEQ ID NO: 16982 - protein, 3 aa, Homo sapiens
KCF

SEQ ID NO: 16983 - protein, 3 aa, Homo sapiens
KCF

SEQ ID NO: 16984 - protein, 28 aa, Homo sapiens
CDVDIRKDLYANTVLSGGTTMYPGIADR

SEQ ID NO: 16985 - protein, 28 aa, Homo sapiens
CDVDIRKDLYANTVLSGGTTMYPGIADR

SEQ ID NO: 16986 - protein, 22 aa, Homo sapiens
KDLYANTVLSGGTTMYPGIADR

SEQ ID NO: 16987 - protein, 28 aa, Homo sapiens
CDVDIRKDLYANTVLSGGTTMYPGIADR

SEQ ID NO: 16988 - protein, 9 aa, Homo sapiens
IKIIAPPER

SEQ ID NO: 16989 - protein, 22 aa, Homo sapiens
KDLYANTVLSGGTTMYPGIADR

SEQ ID NO: 16990 - protein, 20 aa, Homo sapiens
EITALAPSTMKIKIIAPPER

SEQ ID NO: 16991 - protein, 22 aa, Homo sapiens
KDLYANTVLSGGTTMYPGIADR

SEQ ID NO: 16992 - protein, 22 aa, Homo sapiens
KDLYANTVLSGGTTMYPGIADR

SEQ ID NO: 16993 - protein, 9 aa, Homo sapiens
IKIIAPPER

SEQ ID NO: 16994 - protein, 9 aa, Homo sapiens
IKIIAPPER

SEQ ID NO: 16995 - protein, 22 aa, Homo sapiens
KDLYANTVLSGGTTMYPGIADR

SEQ ID NO: 16996 - protein, 22 aa, Homo sapiens
KDLYANTVLSGGTTMYPGIADR

SEQ ID NO: 16997 - protein, 9 aa, Homo sapiens
IKIIAPPER

SEQ ID NO: 16998 - protein, 9 aa, Homo sapiens
IKIIAPPER

SEQ ID NO: 16999 - protein, 9 aa, Homo sapiens
IKIIAPPER

SEQ ID NO: 17000 - protein, 28 aa, Homo sapiens
CDVDIRKDLYANTVLSGGTTMYPGIADR

SEQ ID NO: 17001 - protein, 22 aa, Homo sapiens
KDLYANTVLSGGTTMYPGIADR

SEQ ID NO: 17002 - protein, 9 aa, Homo sapiens
IKIIAPPER

SEQ ID NO: 17003 - protein, 22 aa, Homo sapiens
KDLYANTVLSGGTTMYPGIADR

SEQ ID NO: 17004 - protein, 22 aa, Homo sapiens
KDLYANTVLSGGTTMYPGIADR

SEQ ID NO: 17005 - protein, 22 aa, Homo sapiens
KDLYANTVLSGGTTMYPGIADR

SEQ ID NO: 17006 - protein, 22 aa, Homo sapiens
KDLYANTVLSGGTTMYPGIADR

SEQ ID NO: 17007 - protein, 22 aa, Homo sapiens
KDLYANTVLSGGTTMYPGIADR

SEQ ID NO: 17008 - protein, 28 aa, Homo sapiens
CDVDIRKDLYANTVLSGGTTMYPGIADR

SEQ ID NO: 17009 - protein, 28 aa, Homo sapiens
CDVDIRKDLYANTVLSGGTTMYPGIADR

SEQ ID NO: 17010 - protein, 22 aa, Homo sapiens
KDLYANTVLSGGTTMYPGIADR

SEQ ID NO: 17011 - protein, 28 aa, Homo sapiens
CDVDIRKDLYANTVLSGGTTMYPGIADR

SEQ ID NO: 17012 - protein, 28 aa, Homo sapiens
CDVDIRKDLYANTVLSGGTTMYPGIADR

SEQ ID NO: 17013 - protein, 20 aa, Homo sapiens
EITALAPSTMKIKIIAPPER

SEQ ID NO: 17014 - protein, 13 aa, Homo sapiens
EITALAPSTMKIK

SEQ ID NO: 17015 - protein, 13 aa, Homo sapiens
EITALAPSTMKIK

SEQ ID NO: 17016 - protein, 28 aa, Homo sapiens
CDVDIRKDLYANTVLSGGTTMYPGIADR

SEQ ID NO: 17017 - protein, 13 aa, Homo sapiens
EITALAPSTMKIK

SEQ ID NO: 17018 - protein, 9 aa, Homo sapiens
RTDMYTKKN

SEQ ID NO: 17019 - protein, 16 aa, Homo sapiens
KNVPSKSKAAASATRE

SEQ ID NO: 17020 - protein, 14 aa, Homo sapiens
RTDMYTKKNVPSKS

SEQ ID NO: 17021 - protein, 14 aa, Homo sapiens
RTDMYTKKNVPSKS

SEQ ID NO: 17022 - protein, 14 aa, Homo sapiens
RTDMYTKKNVPSKS

SEQ ID NO: 17023 - protein, 17 aa, Homo sapiens
KMKEEVPTALVEAHVRK

SEQ ID NO: 17024 - protein, 7 aa, Homo sapiens
KTKVERD

SEQ ID NO: 17025 - protein, 25 aa, Homo sapiens
KSALEEFSKMKEEVPTALVEAHVRK

SEQ ID NO: 17026 - protein, 9 aa, Homo sapiens
RKVEEAAKV

SEQ ID NO: 17027 - protein, 9 aa, Homo sapiens
RKVEEAAKV

SEQ ID NO: 17028 - protein, 17 aa, Homo sapiens
KMKEEVPTALVEAHVRK

SEQ ID NO: 17029 - protein, 17 aa, Homo sapiens
KMKEEVPTALVEAHVRK

SEQ ID NO: 17030 - protein, 17 aa, Homo sapiens
KMKEEVPTALVEAHVRK

SEQ ID NO: 17031 - protein, 13 aa, Homo sapiens
KSKTPEIYLAYRN

SEQ ID NO: 17032 - protein, 14 aa, Homo sapiens
RRALPEFFNGKNKS

SEQ ID NO: 17033 - protein, 8 aa, Homo sapiens
KKNVPSKS

SEQ ID NO: 17034 - protein, 32 aa, Homo sapiens; identical to SEQ ID NO: 5995

SEQ ID NO: 17035 - protein, 16 aa, Homo sapiens
KTVNTKKDSESAPVKG

SEQ ID NO: 17036 - protein, 16 aa, Homo sapiens
KTVNTKKDSESAPVKG

SEQ ID NO: 17037 - protein, 16 aa, Homo sapiens
KTVNTKKDSESAPVKG

SEQ ID NO: 17038 - protein, 16 aa, Homo sapiens
KTVNTKKDSESAPVKG

SEQ ID NO: 17039 - protein, 32 aa, Homo sapiens; identical to SEQ ID NO: 5995

SEQ ID NO: 17040 - protein, 16 aa, Homo sapiens
KTVNTKKDSESAPVKG

SEQ ID NO: 17041 - protein, 16 aa, Homo sapiens
KTVNTKKDSESAPVKG

SEQ ID NO: 17042 - protein, 16 aa, Homo sapiens
KTVNTKKDSESAPVKG

SEQ ID NO: 17043 - protein, 8 aa, Homo sapiens
RKTKVERD

SEQ ID NO: 17044 - protein, 8 aa, Homo sapiens
RKTKVERD

SEQ ID NO: 17045 - protein, 8 aa, Homo sapiens
RKTKVERD

SEQ ID NO: 17046 - protein, 13 aa, Homo sapiens
RKVEEAAKVTGKA

SEQ ID NO: 17047 - protein, 7 aa, Homo sapiens
KTKVERD

SEQ ID NO: 17048 - protein, 8 aa, Homo sapiens
KLKDIIKR

SEQ ID NO: 17049 - protein, 8 aa, Homo sapiens
RKTKVERD

SEQ ID NO: 17050 - protein, 8 aa, Homo sapiens
RKTKVERD

SEQ ID NO: 17051 - protein, 17 aa, Homo sapiens
RVASAAAKSALEEFSKM

SEQ ID NO: 17052 - protein, 7 aa, Homo sapiens
KTKVERD

SEQ ID NO: 17053 - protein, 12 aa, Homo sapiens
KAKHLAAVEERK

SEQ ID NO: 17054 - protein, 12 aa, Homo sapiens
KAKHLAAVEERK

SEQ ID NO: 17055 - protein, 12 aa, Homo sapiens
KAKHLAAVEERK

SEQ ID NO: 17056 - protein, 11 aa, Homo sapiens
KKDSESAPVKG

SEQ ID NO: 17057 - protein, 9 aa, Homo sapiens
RKVEEAAKV

SEQ ID NO: 17058 - protein, 8 aa, Homo sapiens
RKTKVERD

SEQ ID NO: 17059 - protein, 8 aa, Homo sapiens
RKTKVERD

SEQ ID NO: 17060 - protein, 9 aa, Homo sapiens
RKVEEAAKV

SEQ ID NO: 17061 - protein, 16 aa, Homo sapiens
KGKEKPTDMQNFGLRT

SEQ ID NO: 17062 - protein, 16 aa, Homo sapiens
KGKEKPTDMQNFGLRT

SEQ ID NO: 17063 - protein, 10 aa, Homo sapiens
RDKKGGNYKK

SEQ ID NO: 17064 - protein, 11 aa, Homo sapiens
RKKDGGPNVKY

SEQ ID NO: 17065 - protein, 20 aa, Homo sapiens
KEGQEEVLKEVVESEGERKT

SEQ ID NO: 17066 - protein, 28 aa, Homo sapiens
KTKVERDIGEGNLSTAAAAALAAAAVKA

SEQ ID NO: 17067 - protein, 20 aa, Homo sapiens
KEGQEEVLKEVVESEGERKT

SEQ ID NO: 17068 - protein, 19 aa, Homo sapiens
KEGQEEVLKEVVESEGERK

SEQ ID NO: 17069 - protein, 19 aa, Homo sapiens
KEGQEEVLKEVVESEGERK

SEQ ID NO: 17070 - protein, 8 aa, Homo sapiens
RKTKVERD

SEQ ID NO: 17071 - protein, 8 aa, Homo sapiens
RKTKVERD

SEQ ID NO: 17072 - protein, 13 aa, Homo sapiens
KKYIQAEPPTNKS

SEQ ID NO: 17073 - protein, 14 aa, Homo sapiens
KEKPTDMQNFGLRT

SEQ ID NO: 17074 - protein, 21 aa, Homo sapiens
KTPQQTSASQQMLNFPDKGKE

SEQ ID NO: 17075 - protein, 14 aa, Homo sapiens
KEKPTDMQNFGLRT

SEQ ID NO: 17076 - protein, 14 aa, Homo sapiens
KEKPTDMQNFGLRT

SEQ ID NO: 17077 - protein, 21 aa, Homo sapiens
KTPQQTSASQQMLNFPDKGKE

SEQ ID NO: 17078 - protein, 21 aa, Homo sapiens
KTPQQTSASQQMLNFPDKGKE

SEQ ID NO: 17079 - protein, 21 aa, Homo sapiens
KTPQQTSASQQMLNFPDKGKE

SEQ ID NO: 17080 - protein, 21 aa, Homo sapiens
KTPQQTSASQQMLNFPDKGKE

SEQ ID NO: 17081 - protein, 21 aa, Homo sapiens
KTPQQTSASQQMLNFPDKGKE

SEQ ID NO: 17082 - protein, 21 aa, Homo sapiens
KTPQQTSASQQMLNFPDKGKE

SEQ ID NO: 17083 - protein, 14 aa, Homo sapiens
KEKPTDMQNFGLRT

SEQ ID NO: 17084 - protein, 8 aa, Homo sapiens
RKTKVERD

SEQ ID NO: 17085 - protein, 8 aa, Homo sapiens
RKTKVERD

SEQ ID NO: 17086 - protein, 7 aa, Homo sapiens
KTKVERD

SEQ ID NO: 17087 - protein, 18 aa, Homo sapiens
RDLKTMTDVVGNPEEERR

SEQ ID NO: 17088 - protein, 21 aa, Homo sapiens
RKRPAPQQIQQVQQQAVQNRN

SEQ ID NO: 17089 - protein, 23 aa, Homo sapiens
RTATTQETDGFQVKRPGDVNVRC

SEQ ID NO: 17090 - protein, 23 aa, Homo sapiens
RTATTQETDGFQVKRPGDVNVRC

SEQ ID NO: 17091 - protein, 23 aa, Homo sapiens
RTATTQETDGFQVKRPGDVNVRC

SEQ ID NO: 17092 - protein, 23 aa, Homo sapiens
RTATTQETDGFQVKRPGDVNVRC

SEQ ID NO: 17093 - protein, 23 aa, Homo sapiens
RTATTQETDGFQVKRPGDVNVRC

SEQ ID NO: 17094 - protein, 23 aa, Homo sapiens
RTATTQETDGFQVKRPGDVNVRC

SEQ ID NO: 17095 - protein, 23 aa, Homo sapiens
RTATTQETDGFQVKRPGDVNVRC

SEQ ID NO: 17096 - protein, 23 aa, Homo sapiens
RTATTQETDGFQVKRPGDVNVRC

SEQ ID NO: 17097 - protein, 23 aa, Homo sapiens
RTATTQETDGFQVKRPGDVNVRC

SEQ ID NO: 17098 - protein, 23 aa, Homo sapiens
RTATTQETDGFQVKRPGDVNVRC

SEQ ID NO: 17099 - protein, 23 aa, Homo sapiens
RTATTQETDGFQVKRPGDVNVRC

SEQ ID NO: 17100 - protein, 23 aa, Homo sapiens
RTATTQETDGFQVKRPGDVNVRC

SEQ ID NO: 17101 - protein, 23 aa, Homo sapiens
RTATTQETDGFQVKRPGDVNVRC

SEQ ID NO: 17102 - protein, 23 aa, Homo sapiens
RTATTQETDGFQVKRPGDVNVRC

SEQ ID NO: 17103 - protein, 23 aa, Homo sapiens
RTATTQETDGFQVKRPGDVNVRC

SEQ ID NO: 17104 - protein, 23 aa, Homo sapiens
RTATTQETDGFQVKRPGDVNVRC

SEQ ID NO: 17105 - protein, 23 aa, Homo sapiens
RTATTQETDGFQVKRPGDVNVRC

SEQ ID NO: 17106 - protein, 23 aa, Homo sapiens
RTATTQETDGFQVKRPGDVNVRC

SEQ ID NO: 17107 - protein, 23 aa, Homo sapiens
RTATTQETDGFQVKRPGDVNVRC

SEQ ID NO: 17108 - protein, 23 aa, Homo sapiens
RTATTQETDGFQVKRPGDVNVRC

SEQ ID NO: 17109 - protein, 23 aa, Homo sapiens
RTATTQETDGFQVKRPGDVNVRC

SEQ ID NO: 17110 - protein, 8 aa, Homo sapiens
RPIKQKRK

SEQ ID NO: 17111 - protein, 7 aa, Homo sapiens
RPIKQKR

SEQ ID NO: 17112 - protein, 8 aa, Homo sapiens
RPIKQKRK

SEQ ID NO: 17113 - protein, 12 aa, Homo sapiens
KKMADKILPQRI

SEQ ID NO: 17114 - protein, 11 aa, Homo sapiens
KKGQASLYGKR

SEQ ID NO: 17115 - protein, 12 aa, Homo sapiens
KKGQASLYGKRR

SEQ ID NO: 17116 - protein, 16 aa, Homo sapiens
KNVNLKKDSENTPVKG

SEQ ID NO: 17117 - protein, 16 aa, Homo sapiens
KNVNLKKDSENTPVKG

SEQ ID NO: 17118 - protein, 16 aa, Homo sapiens
KNVNLKKDSENTPVKG

SEQ ID NO: 17119 - protein, 9 aa, Homo sapiens
RKASANARK

SEQ ID NO: 17120 - protein, 9 aa, Homo sapiens
RKASANARK

SEQ ID NO: 17121 - protein, 9 aa, Homo sapiens
RKASANARK

SEQ ID NO: 17122 - protein, 11 aa, Homo sapiens
KKGQASLYGKR

SEQ ID NO: 17123 - protein, 9 aa, Homo sapiens
RKASANARK

SEQ ID NO: 17124 - protein, 11 aa, Homo sapiens
RRKDGGPATKF

SEQ ID NO: 17125 - protein, 9 aa, Homo sapiens
RKASANARK

SEQ ID NO: 17126 - protein, 9 aa, Homo sapiens
RKASANARK

SEQ ID NO: 17127 - protein, 9 aa, Homo sapiens
RKASANARK

SEQ ID NO: 17128 - protein, 9 aa, Homo sapiens
RKASANARK

SEQ ID NO: 17129 - protein, 9 aa, Homo sapiens
RKASANARK

SEQ ID NO: 17130 - protein, 9 aa, Homo sapiens
RKASANARK

SEQ ID NO: 17131 - protein, 9 aa, Homo sapiens
RKASANARK

SEQ ID NO: 17132 - protein, 9 aa, Homo sapiens
RKASANARK

SEQ ID NO: 17133 - protein, 9 aa, Homo sapiens
RKASANARK

SEQ ID NO: 17134 - protein, 9 aa, Homo sapiens
RKASANARK

SEQ ID NO: 17135 - protein, 9 aa, Homo sapiens
RESDTGKKK

SEQ ID NO: 17136 - protein, 9 aa, Homo sapiens
RESDTGKKK

SEQ ID NO: 17137 - protein, 9 aa, Homo sapiens
RESDTGKKK

SEQ ID NO: 17138 - protein, 9 aa, Homo sapiens
RESDTGKKK

SEQ ID NO: 17139 - protein, 9 aa, Homo sapiens
RESDTGKKK

SEQ ID NO: 17140 - protein, 11 aa, Homo sapiens
KERESDTGKKK

SEQ ID NO: 17141 - protein, 18 aa, Homo sapiens
RVREEVPLELVEAHVKKV

SEQ ID NO: 17142 - protein, 16 aa, Homo sapiens
KNVNLKKDSENTPVKG

SEQ ID NO: 17143 - protein, 16 aa, Homo sapiens
KNVNLKKDSENTPVKG

SEQ ID NO: 17144 - protein, 9 aa, Homo sapiens
RESDTGKKK

SEQ ID NO: 17145 - protein, 10 aa, Homo sapiens
RESDTGKKKV

SEQ ID NO: 17146 - protein, 17 aa, Homo sapiens
RVASAAAKAALEEFSRV

SEQ ID NO: 17147 - protein, 17 aa, Homo sapiens
RVASAAAKAALEEFSRV

SEQ ID NO: 17148 - protein, 17 aa, Homo sapiens
RVASAAAKAALEEFSRV

SEQ ID NO: 17149 - protein, 9 aa, Homo sapiens
KKVQEAARA

SEQ ID NO: 17150 - protein, 17 aa, Homo sapiens
RVASAAAKAALEEFSRV

SEQ ID NO: 17151 - protein, 17 aa, Homo sapiens
RVASAAAKAALEEFSRV

SEQ ID NO: 17152 - protein, 10 aa, Homo sapiens
RKDGGPATKF

SEQ ID NO: 17153 - protein, 11 aa, Homo sapiens
RDRKASANARK

SEQ ID NO: 17154 - protein, 9 aa, Homo sapiens
RKASANARK

SEQ ID NO: 17155 - protein, 9 aa, Homo sapiens
KKVQEAARA

SEQ ID NO: 17156 - protein, 20 aa, Homo sapiens
RSPQVPAAQQMLNFPEKNKE

SEQ ID NO: 17157 - protein, 20 aa, Homo sapiens
KEKPVDLQNFGLRTDIYSKK

SEQ ID NO: 17158 - protein, 14 aa, Homo sapiens
KEKPVDLQNFGLRT

SEQ ID NO: 17159 - protein, 20 aa, Homo sapiens
KEKPVDLQNFGLRTDIYSKK

SEQ ID NO: 17160 - protein, 20 aa, Homo sapiens
RSPQVPAAQQMLNFPEKNKE

SEQ ID NO: 17161 - protein, 14 aa, Homo sapiens
KEKPVDLQNFGLRT

SEQ ID NO: 17162 - protein, 20 aa, Homo sapiens
RSPQVPAAQQMLNFPEKNKE

SEQ ID NO: 17163 - protein, 14 aa, Homo sapiens
KEKPVDLQNFGLRT

SEQ ID NO: 17164 - protein, 20 aa, Homo sapiens
RSPQVPAAQQMLNFPEKNKE

SEQ ID NO: 17165 - protein, 20 aa, Homo sapiens
RSPQVPAAQQMLNFPEKNKE

SEQ ID NO: 17166 - protein, 14 aa, Homo sapiens
KEKPVDLQNFGLRT

SEQ ID NO: 17167 - protein, 14 aa, Homo sapiens
KEKPVDLQNFGLRT

SEQ ID NO: 17168 - protein, 20 aa, Homo sapiens
RSPQVPAAQQMLNFPEKNKE

SEQ ID NO: 17169 - protein, 20 aa, Homo sapiens
RSPQVPAAQQMLNFPEKNKE

SEQ ID NO: 17170 - protein, 20 aa, Homo sapiens
RSPQVPAAQQMLNFPEKNKE

SEQ ID NO: 17171 - protein, 20 aa, Homo sapiens
RSPQVPAAQQMLNFPEKNKE

SEQ ID NO: 17172 - protein, 20 aa, Homo sapiens
RSPQVPAAQQMLNFPEKNKE

SEQ ID NO: 17173 - protein, 22 aa, Homo sapiens
RSPQVPAAQQMLNFPEKNKEKP

SEQ ID NO: 17174 - protein, 20 aa, Homo sapiens
RSPQVPAAQQMLNFPEKNKE

SEQ ID NO: 17175 - protein, 20 aa, Homo sapiens
RSPQVPAAQQMLNFPEKNKE

SEQ ID NO: 17176 - protein, 20 aa, Homo sapiens
KEKPVDLQNFGLRTDIYSKK

SEQ ID NO: 17177 - protein, 20 aa, Homo sapiens
RSPQVPAAQQMLNFPEKNKE

SEQ ID NO: 17178 - protein, 20 aa, Homo sapiens
RSPQVPAAQQMLNFPEKNKE

SEQ ID NO: 17179 - protein, 20 aa, Homo sapiens
RSPQVPAAQQMLNFPEKNKE

SEQ ID NO: 17180 - protein, 20 aa, Homo sapiens
RSPQVPAAQQMLNFPEKNKE

SEQ ID NO: 17181 - protein, 20 aa, Homo sapiens
RSPQVPAAQQMLNFPEKNKE

SEQ ID NO: 17182 - protein, 20 aa, Homo sapiens
RSPQVPAAQQMLNFPEKNKE

SEQ ID NO: 17183 - protein, 20 aa, Homo sapiens
RSPQVPAAQQMLNFPEKNKE

SEQ ID NO: 17184 - protein, 20 aa, Homo sapiens
RSPQVPAAQQMLNFPEKNKE

SEQ ID NO: 17185 - protein, 20 aa, Homo sapiens
RSPQVPAAQQMLNFPEKNKE

SEQ ID NO: 17186 - protein, 20 aa, Homo sapiens
KEKPVDLQNFGLRTDIYSKK

SEQ ID NO: 17187 - protein, 14 aa, Homo sapiens
KEKPVDLQNFGLRT

SEQ ID NO: 17188 - protein, 20 aa, Homo sapiens
RSPQVPAAQQMLNFPEKNKE

SEQ ID NO: 17189 - protein, 20 aa, Homo sapiens
RSPQVPAAQQMLNFPEKNKE

SEQ ID NO: 17190 - protein, 20 aa, Homo sapiens
RSPQVPAAQQMLNFPEKNKE

SEQ ID NO: 17191 - protein, 20 aa, Homo sapiens
RSPQVPAAQQMLNFPEKNKE

SEQ ID NO: 17192 - protein, 14 aa, Homo sapiens
KEKPVDLQNFGLRT

SEQ ID NO: 17193 - protein, 14 aa, Homo sapiens
KEKPVDLQNFGLRT

SEQ ID NO: 17194 - protein, 14 aa, Homo sapiens
KEKPVDLQNFGLRT

SEQ ID NO: 17195 - protein, 36 aa, Homo sapiens; identical to SEQ ID NO: 6516

SEQ ID NO: 17196 - protein, 36 aa, Homo sapiens; identical to SEQ ID NO: 6516

SEQ ID NO: 17197 - protein, 9 aa, Homo sapiens
KKVQEAARA

SEQ ID NO: 17198 - protein, 34 aa, Homo sapiens; identical to SEQ ID NO: 16006

SEQ ID NO: 17199 - protein, 16 aa, Homo sapiens
KNVNLKKDSENTPVKG

SEQ ID NO: 17200 - protein, 13 aa, Homo sapiens
RTDIYSKKTLAKS

SEQ ID NO: 17201 - protein, 14 aa, Homo sapiens
KTLAKSKGASAGRE

SEQ ID NO: 17202 - protein, 8 aa, Homo sapiens
KTLAKSKG

SEQ ID NO: 17203 - protein, 9 aa, Homo sapiens
RTDIYSKKT

SEQ ID NO: 17204 - protein, 16 aa, Homo sapiens
RMSYEPNKDPYGSMRK

SEQ ID NO: 17205 - protein, 16 aa, Homo sapiens
RMSYEPNKDPYGSMRK

SEQ ID NO: 17206 - protein, 16 aa, Homo sapiens
RMSYEPNKDPYGSMRK

SEQ ID NO: 17207 - protein, 16 aa, Homo sapiens
RMSYEPNKDPYGSMRK

SEQ ID NO: 17208 - protein, 16 aa, Homo sapiens
RMSYEPNKDPYGSMRK

SEQ ID NO: 17209 - protein, 23 aa, Homo sapiens
RSNSVGIQDAFNDGSDSTFQKRN

SEQ ID NO: 17210 - protein, 23 aa, Homo sapiens
RSNSVGIQDAFNDGSDSTFQKRN

SEQ ID NO: 17211 - protein, 23 aa, Homo sapiens
RSNSVGIQDAFNDGSDSTFQKRN

SEQ ID NO: 17212 - protein, 27 aa, Homo sapiens
RKAPGSDPFMSSGQGPNGGMGDPYSRA

SEQ ID NO: 17213 - protein, 12 aa, Homo sapiens
RLEKLYSTMVRF

SEQ ID NO: 17214 - protein, 12 aa, Homo sapiens
RLEKLYSTMVRF

SEQ ID NO: 17215 - protein, 12 aa, Homo sapiens
RLEKLYSTMVRF

SEQ ID NO: 17216 - protein, 17 aa, Homo sapiens
KDKPASENSEEKLISKF

SEQ ID NO: 17217 - protein, 9 aa, Homo sapiens
KFDKLPVKI

SEQ ID NO: 17218 - protein, 9 aa, Homo sapiens
KFDKLPVKI

SEQ ID NO: 17219 - protein, 13 aa, Homo sapiens
KFDKLPVKIVQKN

SEQ ID NO: 17220 - protein, 16 aa, Homo sapiens
RMSYEPNKDPYGSMRK

SEQ ID NO: 17221 - protein, 16 aa, Homo sapiens
RMSYEPNKDPYGSMRK

SEQ ID NO: 17222 - protein, 27 aa, Homo sapiens
RKAPGSDPFMSSGQGPNGGMGDPYSRA

SEQ ID NO: 17223 - protein, 16 aa, Homo sapiens
RMSYEPNKDPYGSMRK

SEQ ID NO: 17224 - protein, 27 aa, Homo sapiens
RKAPGSDPFMSSGQGPNGGMGDPYSRA

SEQ ID NO: 17225 - protein, 27 aa, Homo sapiens
RKAPGSDPFMSSGQGPNGGMGDPYSRA

SEQ ID NO: 17226 - protein, 27 aa, Homo sapiens
RKAPGSDPFMSSGQGPNGGMGDPYSRA

SEQ ID NO: 17227 - protein, 16 aa, Homo sapiens
RMSYEPNKDPYGSMRK

SEQ ID NO: 17228 - protein, 16 aa, Homo sapiens
RMSYEPNKDPYGSMRK

SEQ ID NO: 17229 - protein, 27 aa, Homo sapiens
RKAPGSDPFMSSGQGPNGGMGDPYSRA

SEQ ID NO: 17230 - protein, 27 aa, Homo sapiens
RKAPGSDPFMSSGQGPNGGMGDPYSRA

SEQ ID NO: 17231 - protein, 27 aa, Homo sapiens
RKAPGSDPFMSSGQGPNGGMGDPYSRA

SEQ ID NO: 17232 - protein, 27 aa, Homo sapiens
RKAPGSDPFMSSGQGPNGGMGDPYSRA

SEQ ID NO: 17233 - protein, 16 aa, Homo sapiens
RMSYEPNKDPYGSMRK

SEQ ID NO: 17234 - protein, 27 aa, Homo sapiens
RKAPGSDPFMSSGQGPNGGMGDPYSRA

SEQ ID NO: 17235 - protein, 27 aa, Homo sapiens
RKAPGSDPFMSSGQGPNGGMGDPYSRA

SEQ ID NO: 17236 - protein, 27 aa, Homo sapiens
RKAPGSDPFMSSGQGPNGGMGDPYSRA

SEQ ID NO: 17237 - protein, 27 aa, Homo sapiens
RKAPGSDPFMSSGQGPNGGMGDPYSRA

SEQ ID NO: 17238 - protein, 27 aa, Homo sapiens
RKAPGSDPFMSSGQGPNGGMGDPYSRA

SEQ ID NO: 17239 - protein, 27 aa, Homo sapiens
RKAPGSDPFMSSGQGPNGGMGDPYSRA

SEQ ID NO: 17240 - protein, 16 aa, Homo sapiens
RMSYEPNKDPYGSMRK

SEQ ID NO: 17241 - protein, 27 aa, Homo sapiens
RKAPGSDPFMSSGQGPNGGMGDPYSRA

SEQ ID NO: 17242 - protein, 18 aa, Homo sapiens
KESSKFPFGISPAQSHRN

SEQ ID NO: 17243 - protein, 18 aa, Homo sapiens
KESSKFPFGISPAQSHRN

SEQ ID NO: 17244 - protein, 18 aa, Homo sapiens
KESSKFPFGISPAQSHRN

SEQ ID NO: 17245 - protein, 18 aa, Homo sapiens
KESSKFPFGISPAQSHRN

SEQ ID NO: 17246 - protein, 29 aa, Homo sapiens
RKHVTTAEGTPGTTDQEGPPPDGPPEKRI

SEQ ID NO: 17247 - protein, 14 aa, Homo sapiens
KLILLHHKHPERKQ

SEQ ID NO: 17248 - protein, 9 aa, Homo sapiens
RKPLDLYRL

SEQ ID NO: 17249 - protein, 9 aa, Homo sapiens
RKPLDLYRL

SEQ ID NO: 17250 - protein, 9 aa, Homo sapiens
RKPLDLYRL

SEQ ID NO: 17251 - protein, 9 aa, Homo sapiens
RKPLDLYRL

SEQ ID NO: 17252 - protein, 9 aa, Homo sapiens
RKPLDLYRL

SEQ ID NO: 17253 - protein, 9 aa, Homo sapiens
RKPLDLYRL

SEQ ID NO: 17254 - protein, 9 aa, Homo sapiens
RKPLDLYRL

SEQ ID NO: 17255 - protein, 9 aa, Homo sapiens
RKPLDLYRL

SEQ ID NO: 17256 - protein, 9 aa, Homo sapiens
RKPLDLYRL

SEQ ID NO: 17257 - protein, 9 aa, Homo sapiens
KKAEQQQRE

SEQ ID NO: 17258 - protein, 31 aa, Homo sapiens; identical to SEQ ID NO: 424

SEQ ID NO: 17259 - protein, 31 aa, Homo sapiens; identical to SEQ ID NO: 424

SEQ ID NO: 17260 - protein, 27 aa, Homo sapiens
RKAPGSDPFMSSGQGPNGGMGDPYSRA

SEQ ID NO: 17261 - protein, 10 aa, Homo sapiens
KYKDSSSGRQ

SEQ ID NO: 17262 - protein, 7 aa, Homo sapiens
RLKGGRR

SEQ ID NO: 17263 - protein, 10 aa, Homo sapiens
KYKDSSSGRQ

SEQ ID NO: 17264 - protein, 10 aa, Homo sapiens
KYKDSSSGRQ

SEQ ID NO: 17265 - protein, 10 aa, Homo sapiens
KYKDSSSGRQ

SEQ ID NO: 17266 - protein, 7 aa, Homo sapiens
RLKGGRR

SEQ ID NO: 17267 - protein, 13 aa, Homo sapiens
RKELPEYYELIRK

SEQ ID NO: 17268 - protein, 13 aa, Homo sapiens
RKELPEYYELIRK

SEQ ID NO: 17269 - protein, 8 aa, Homo sapiens
RKPVDFKK

SEQ ID NO: 17270 - protein, 12 aa, Homo sapiens
KVSYKGSPAARR

SEQ ID NO: 17271 - protein, 12 aa, Homo sapiens
KVSYKGSPAARR

SEQ ID NO: 17272 - protein, 12 aa, Homo sapiens
KVSYKGSPAARR

SEQ ID NO: 17273 - protein, 10 aa, Homo sapiens
KYKLNVDQKV

SEQ ID NO: 17274 - protein, 10 aa, Homo sapiens
KYKLNVDQKV

SEQ ID NO: 17275 - protein, 12 aa, Homo sapiens
KVSYKGSPAARR

SEQ ID NO: 17276 - protein, 11 aa, Homo sapiens
KENERIEKERM

SEQ ID NO: 17277 - protein, 11 aa, Homo sapiens
KENERIEKERM

SEQ ID NO: 17278 - protein, 11 aa, Homo sapiens
KENERIEKERM

SEQ ID NO: 17279 - protein, 11 aa, Homo sapiens
KENERIEKERM

SEQ ID NO: 17280 - protein, 11 aa, Homo sapiens
KENERIEKERM

SEQ ID NO: 17281 - protein, 11 aa, Homo sapiens
KENERIEKERM

SEQ ID NO: 17282 - protein, 17 aa, Homo sapiens
KAVATYHANTEREQKKE

SEQ ID NO: 17283 - protein, 11 aa, Homo sapiens
KENERIEKERM

SEQ ID NO: 17284 - protein, 11 aa, Homo sapiens
KENERIEKERM

SEQ ID NO: 17285 - protein, 11 aa, Homo sapiens
KENERIEKERM

SEQ ID NO: 17286 - protein, 8 aa, Homo sapiens
KLIDQKKD

SEQ ID NO: 17287 - protein, 10 aa, Homo sapiens
REQKKENERI

SEQ ID NO: 17288 - protein, 9 aa, Homo sapiens
RIRNHKYRS

SEQ ID NO: 17289 - protein, 19 aa, Homo sapiens
RGRPPAEKLSPNPPNLTKK

SEQ ID NO: 17290 - protein, 7 aa, Homo sapiens
RLKGGRR

SEQ ID NO: 17291 - protein, 19 aa, Homo sapiens
KKKIPDPDSDDVSEVDARH

SEQ ID NO: 17292 - protein, 19 aa, Homo sapiens
KKKIPDPDSDDVSEVDARH

SEQ ID NO: 17293 - protein, 18 aa, Homo sapiens
RLMAEDEEGYRKLIDQKK

SEQ ID NO: 17294 - protein, 18 aa, Homo sapiens
RLMAEDEEGYRKLIDQKK

SEQ ID NO: 17295 - protein, 18 aa, Homo sapiens
RLMAEDEEGYRKLIDQKK

SEQ ID NO: 17296 - protein, 6 aa, Homo sapiens
KKDKRL

SEQ ID NO: 17297 - protein, 18 aa, Homo sapiens
RLMAEDEEGYRKLIDQKK

SEQ ID NO: 17298 - protein, 10 aa, Homo sapiens
KEKAQDRLKG

SEQ ID NO: 17299 - protein, 9 aa, Homo sapiens
RKEKAQDRL

SEQ ID NO: 17300 - protein, 12 aa, Homo sapiens
RYNQMKGMGMRS

SEQ ID NO: 17301 - protein, 19 aa, Homo sapiens
KKKIPDPDSDDVSEVDARH

SEQ ID NO: 17302 - protein, 9 aa, Homo sapiens
RKPVDFKKI

SEQ ID NO: 17303 - protein, 8 aa, Homo sapiens
RKPVDFKK

SEQ ID NO: 17304 - protein, 7 aa, Homo sapiens
KKIKERI

SEQ ID NO: 17305 - protein, 15 aa, Homo sapiens
KYLRLDGTTKAEDRG

SEQ ID NO: 17306 - protein, 12 aa, Homo sapiens
RLDGTTKAEDRG

SEQ ID NO: 17307 - protein, 15 aa, Homo sapiens
KYLRLDGTTKAEDRG

SEQ ID NO: 17308 - protein, 12 aa, Homo sapiens
RLDGTTKAEDRG

SEQ ID NO: 17309 - protein, 17 aa, Homo sapiens
RLDGTTKAEDRGMLLKT

SEQ ID NO: 17310 - protein, 12 aa, Homo sapiens
RLDGTTKAEDRG

SEQ ID NO: 17311 - protein, 17 aa, Homo sapiens
RLDGTTKAEDRGMLLKT

SEQ ID NO: 17312 - protein, 12 aa, Homo sapiens
RLDGTTKAEDRG

SEQ ID NO: 17313 - protein, 12 aa, Homo sapiens
RLDGTTKAEDRG

SEQ ID NO: 17314 - protein, 6 aa, Homo sapiens
KKSSRK

SEQ ID NO: 17315 - protein, 6 aa, Homo sapiens
KKSSRK

SEQ ID NO: 17316 - protein, 6 aa, Homo sapiens
KKSSRK

SEQ ID NO: 17317 - protein, 6 aa, Homo sapiens
KKSSRK

SEQ ID NO: 17318 - protein, 12 aa, Homo sapiens
KVSYKGSPAARR

SEQ ID NO: 17319 - protein, 12 aa, Homo sapiens
KVSYKGSPAARR

SEQ ID NO: 17320 - protein, 12 aa, Homo sapiens
KVSYKGSPAARR

SEQ ID NO: 17321 - protein, 10 aa, Homo sapiens
KQQKIEQERK

SEQ ID NO: 17322 - protein, 9 aa, Homo sapiens
RITEKLEKQ

SEQ ID NO: 17323 - protein, 15 aa, Homo sapiens
RLTCEEEEEKMFGRG

SEQ ID NO: 17324 - protein, 15 aa, Homo sapiens
RLTCEEEEEKMFGRG

SEQ ID NO: 17325 - protein, 15 aa, Homo sapiens
RLTCEEEEEKMFGRG

SEQ ID NO: 17326 - protein, 15 aa, Homo sapiens
RLTCEEEEEKMFGRG

SEQ ID NO: 17327 - protein, 11 aa, Homo sapiens
KAQDRLKGGRR

SEQ ID NO: 17328 - protein, 9 aa, Homo sapiens
RKEKAQDRL

SEQ ID NO: 17329 - protein, 9 aa, Homo sapiens
RKEKAQDRL

SEQ ID NO: 17330 - protein, 10 aa, Homo sapiens
RSVTGKIQKL

SEQ ID NO: 17331 - protein, 19 aa, Homo sapiens
KLTKAVATYHANTEREQKK

SEQ ID NO: 17332 - protein, 9 aa, Homo sapiens
KVKIKLGRK

SEQ ID NO: 17333 - protein, 9 aa, Homo sapiens
KVKIKLGRK

SEQ ID NO: 17334 - protein, 9 aa, Homo sapiens
RKEKAQDRL

SEQ ID NO: 17335 - protein, 9 aa, Homo sapiens
RKEKAQDRL

SEQ ID NO: 17336 - protein, 9 aa, Homo sapiens
RKEKAQDRL

SEQ ID NO: 17337 - protein, 9 aa, Homo sapiens
RKEKAQDRL

SEQ ID NO: 17338 - protein, 7 aa, Homo sapiens
KIKLGRK

SEQ ID NO: 17339 - protein, 7 aa, Homo sapiens
KIKLGRK

SEQ ID NO: 17340 - protein, 9 aa, Homo sapiens
RKEKAQDRL

SEQ ID NO: 17341 - protein, 9 aa, Homo sapiens
KVKIKLGRK

SEQ ID NO: 17342 - protein, 6 aa, Homo sapiens
KKSSRK

SEQ ID NO: 17343 - protein, 7 aa, Homo sapiens
KKIKERI

SEQ ID NO: 17344 - protein, 9 aa, Homo sapiens
RIRNHKYRS

SEQ ID NO: 17345 - protein, 8 aa, Homo sapiens
KEKAQDRL

SEQ ID NO: 17346 - protein, 12 aa, Homo sapiens
KVSYKGSPAARR

SEQ ID NO: 17347 - protein, 8 aa, Homo sapiens
RGFKYLRL

SEQ ID NO: 17348 - protein, 8 aa, Homo sapiens
RGFKYLRL

SEQ ID NO: 17349 - protein, 12 aa, Homo sapiens
KVSYKGSPAARR

SEQ ID NO: 17350 - protein, 7 aa, Homo sapiens
RLKGGRR

SEQ ID NO: 17351 - protein, 12 aa, Homo sapiens
KVSYKGSPAARR

SEQ ID NO: 17352 - protein, 12 aa, Homo sapiens
RASGKFELLDRI

SEQ ID NO: 17353 - protein, 18 aa, Homo sapiens
RKRDSDAGSSTPTTSTRS

SEQ ID NO: 17354 - protein, 6 aa, Homo sapiens
KKSSRK

SEQ ID NO: 17355 - protein, 12 aa, Homo sapiens
KVSYKGSPAARR

SEQ ID NO: 17356 - protein, 31 aa, Homo sapiens; identical to SEQ ID NO: 6559

SEQ ID NO: 17357 - protein, 31 aa, Homo sapiens; identical to SEQ ID NO: 6559

SEQ ID NO: 17358 - protein, 25 aa, Homo sapiens
RAGYAGEDCPKVDFPTAIGMVVERD

SEQ ID NO: 17359 - protein, 18 aa, Homo sapiens
KGKQGGPTYYIDTNALRV

SEQ ID NO: 17360 - protein, 25 aa, Homo sapiens
RAGYAGEDCPKVDFPTAIGMVVERD

SEQ ID NO: 17361 - protein, 18 aa, Homo sapiens
KGKQGGPTYYIDTNALRV

SEQ ID NO: 17362 - protein, 25 aa, Homo sapiens
RAGYAGEDCPKVDFPTAIGMVVERD

SEQ ID NO: 17363 - protein, 31 aa, Homo sapiens; identical to SEQ ID NO: 6559

SEQ ID NO: 17364 - protein, 31 aa, Homo sapiens; identical to SEQ ID NO: 6559

SEQ ID NO: 17365 - protein, 31 aa, Homo sapiens; identical to SEQ ID NO: 6559

SEQ ID NO: 17366 - protein, 25 aa, Homo sapiens
RAGYAGEDCPKVDFPTAIGMVVERD

SEQ ID NO: 17367 - protein, 18 aa, Homo sapiens
KGKQGGPTYYIDTNALRV

SEQ ID NO: 17368 - protein, 25 aa, Homo sapiens
RAGYAGEDCPKVDFPTAIGMVVERD

SEQ ID NO: 17369 - protein, 18 aa, Homo sapiens
KGKQGGPTYYIDTNALRV

SEQ ID NO: 17370 - protein, 18 aa, Homo sapiens
KGKQGGPTYYIDTNALRV

SEQ ID NO: 17371 - protein, 18 aa, Homo sapiens
KGKQGGPTYYIDTNALRV

SEQ ID NO: 17372 - protein, 25 aa, Homo sapiens
RAGYAGEDCPKVDFPTAIGMVVERD

SEQ ID NO: 17373 - protein, 25 aa, Homo sapiens
RAGYAGEDCPKVDFPTAIGMVVERD

SEQ ID NO: 17374 - protein, 25 aa, Homo sapiens
RAGYAGEDCPKVDFPTAIGMVVERD

SEQ ID NO: 17375 - protein, 25 aa, Homo sapiens
RAGYAGEDCPKVDFPTAIGMVVERD

SEQ ID NO: 17376 - protein, 31 aa, Homo sapiens; identical to SEQ ID NO: 6559

SEQ ID NO: 17377 - protein, 31 aa, Homo sapiens; identical to SEQ ID NO: 6559

SEQ ID NO: 17378 - protein, 25 aa, Homo sapiens
RAGYAGEDCPKVDFPTAIGMVVERD

SEQ ID NO: 17379 - protein, 31 aa, Homo sapiens; identical to SEQ ID NO: 6559

SEQ ID NO: 17380 - protein, 25 aa, Homo sapiens
RAGYAGEDCPKVDFPTAIGMVVERD

SEQ ID NO: 17381 - protein, 25 aa, Homo sapiens
RAGYAGEDCPKVDFPTAIGMVVERD

SEQ ID NO: 17382 - protein, 25 aa, Homo sapiens
RAGYAGEDCPKVDFPTAIGMVVERD

SEQ ID NO: 17383 - protein, 31 aa, Homo sapiens; identical to SEQ ID NO: 6559

SEQ ID NO: 17384 - protein, 31 aa, Homo sapiens; identical to SEQ ID NO: 6559

SEQ ID NO: 17385 - protein, 25 aa, Homo sapiens
RAGYAGEDCPKVDFPTAIGMVVERD

SEQ ID NO: 17386 - protein, 31 aa, Homo sapiens; identical to SEQ ID NO: 6559

SEQ ID NO: 17387 - protein, 31 aa, Homo sapiens; identical to SEQ ID NO: 6559

SEQ ID NO: 17388 - protein, 15 aa, Homo sapiens
KEAVREGSPANWKRK

SEQ ID NO: 17389 - protein, 11 aa, Homo sapiens
RKEKLPQVTRS

SEQ ID NO: 17390 - protein, 11 aa, Homo sapiens
REGSPANWKRK

SEQ ID NO: 17391 - protein, 11 aa, Homo sapiens
RKEKLPQVTRS

SEQ ID NO: 17392 - protein, 11 aa, Homo sapiens
RKEKLPQVTRS

SEQ ID NO: 17393 - protein, 11 aa, Homo sapiens
REGSPANWKRK

SEQ ID NO: 17394 - protein, 15 aa, Homo sapiens
KEAVREGSPANWKRK

SEQ ID NO: 17395 - protein, 11 aa, Homo sapiens
REGSPANWKRK

SEQ ID NO: 17396 - protein, 11 aa, Homo sapiens
RKEKLPQVTRS

SEQ ID NO: 17397 - protein, 11 aa, Homo sapiens
RKEKLPQVTRS

SEQ ID NO: 17398 - protein, 15 aa, Homo sapiens
KEAVREGSPANWKRK

SEQ ID NO: 17399 - protein, 11 aa, Homo sapiens
RKEKLPQVTRS

SEQ ID NO: 17400 - protein, 11 aa, Homo sapiens
RKEKLPQVTRS

SEQ ID NO: 17401 - protein, 11 aa, Homo sapiens
RKEKLPQVTRS

SEQ ID NO: 17402 - protein, 11 aa, Homo sapiens
REGSPANWKRK

SEQ ID NO: 17403 - protein, 15 aa, Homo sapiens
KEAVREGSPANWKRK

SEQ ID NO: 17404 - protein, 15 aa, Homo sapiens
KEAVREGSPANWKRK

SEQ ID NO: 17405 - protein, 11 aa, Homo sapiens
REGSPANWKRK

SEQ ID NO: 17406 - protein, 15 aa, Homo sapiens
KEAVREGSPANWKRK

SEQ ID NO: 17407 - protein, 11 aa, Homo sapiens
RKEKLPQVTRS

SEQ ID NO: 17408 - protein, 15 aa, Homo sapiens
KEAVREGSPANWKRK

SEQ ID NO: 17409 - protein, 11 aa, Homo sapiens
RKEKLPQVTRS

SEQ ID NO: 17410 - protein, 11 aa, Homo sapiens
RKEKLPQVTRS

SEQ ID NO: 17411 - protein, 11 aa, Homo sapiens
RKEKLPQVTRS

SEQ ID NO: 17412 - protein, 11 aa, Homo sapiens
RKEKLPQVTRS

SEQ ID NO: 17413 - protein, 11 aa, Homo sapiens
RKEKLPQVTRS

SEQ ID NO: 17414 - protein, 10 aa, Homo sapiens
KEKLPQVTRS

SEQ ID NO: 17415 - protein, 11 aa, Homo sapiens
RKEKLPQVTRS

SEQ ID NO: 17416 - protein, 22 aa, Homo sapiens
REKLTELMFEHYNIPAFFLCKT

SEQ ID NO: 17417 - protein, 22 aa, Homo sapiens
REKLTELMFEHYNIPAFFLCKT

SEQ ID NO: 17418 - protein, 22 aa, Homo sapiens
REKLTELMFEHYNIPAFFLCKT

SEQ ID NO: 17419 - protein, 15 aa, Homo sapiens
KQEYEEGGKQCVERK

SEQ ID NO: 17420 - protein, 22 aa, Homo sapiens
REKLTELMFEHYNIPAFFLCKT

SEQ ID NO: 17421 - protein, 25 aa, Homo sapiens
RELFQEMNIELVPPYMIASKEAVRE

SEQ ID NO: 17422 - protein, 11 aa, Homo sapiens
RKEKLPQVTRS

SEQ ID NO: 17423 - protein, 11 aa, Homo sapiens
RKEKLPQVTRS

SEQ ID NO: 17424 - protein, 11 aa, Homo sapiens
RKEKLPQVTRS

SEQ ID NO: 17425 - protein, 11 aa, Homo sapiens
RKEKLPQVTRS

SEQ ID NO: 17426 - protein, 25 aa, Homo sapiens
RELFQEMNIELVPPYMIASKEAVRE

SEQ ID NO: 17427 - protein, 11 aa, Homo sapiens
RKEKLPQVTRS

SEQ ID NO: 17428 - protein, 11 aa, Homo sapiens
RKEKLPQVTRS

SEQ ID NO: 17429 - protein, 13 aa, Homo sapiens
RELSQKTPPSMRL

SEQ ID NO: 17430 - protein, 13 aa, Homo sapiens
RELSQKTPPSMRL

SEQ ID NO: 17431 - protein, 17 aa, Homo sapiens
KYKAVSISTEPPTYLRE

SEQ ID NO: 17432 - protein, 17 aa, Homo sapiens
KTTWAIKHAASNPSKKY

SEQ ID NO: 17433 - protein, 11 aa, Homo sapiens
KHAASNPSKKY

SEQ ID NO: 17434 - protein, 11 aa, Homo sapiens
KHAASNPSKKY

SEQ ID NO: 17435 - protein, 11 aa, Homo sapiens
KHAASNPSKKY

SEQ ID NO: 17436 - protein, 19 aa, Homo sapiens
KKRNYILDQTNVYGSAQRR

SEQ ID NO: 17437 - protein, 23 aa, Homo sapiens
KINEEISVKHLPSTEPDPHVVRI

SEQ ID NO: 17438 - protein, 12 aa, Homo sapiens
KNGKWMGIAFRI

SEQ ID NO: 17439 - protein, 12 aa, Homo sapiens
KNGKWMGIAFRI

SEQ ID NO: 17440 - protein, 8 aa, Homo sapiens
KKSTNSRF

SEQ ID NO: 17441 - protein, 23 aa, Homo sapiens
KINEEISVKHLPSTEPDPHVVRI

SEQ ID NO: 17442 - protein, 8 aa, Homo sapiens
KKSTNSRF

SEQ ID NO: 17443 - protein, 23 aa, Homo sapiens
KINEEISVKHLPSTEPDPHVVRI

SEQ ID NO: 17444 - protein, 22 aa, Homo sapiens
RQNQFYDTQVIKQENESGYERR

SEQ ID NO: 17445 - protein, 23 aa, Homo sapiens
RQNQFYDTQVIKQENESGYERRP

SEQ ID NO: 17446 - protein, 11 aa, Homo sapiens
RKAGPPPEKRF

SEQ ID NO: 17447 - protein, 23 aa, Homo sapiens
KHAASNPSKKYNILGTNAIMDKM

SEQ ID NO: 17448 - protein, 16 aa, Homo sapiens
KTTWAIKHAASNPSKK

SEQ ID NO: 17449 - protein, 11 aa, Homo sapiens
RGLKAELAERL

SEQ ID NO: 17450 - protein, 11 aa, Homo sapiens
RGLKAELAERL

SEQ ID NO: 17451 - protein, 11 aa, Homo sapiens
RGLKAELAERL

SEQ ID NO: 17452 - protein, 8 aa, Homo sapiens
KKSTNSRF

SEQ ID NO: 17453 - protein, 8 aa, Homo sapiens
KKSTNSRF

SEQ ID NO: 17454 - protein, 10 aa, Homo sapiens
RGTVGPKSKA

SEQ ID NO: 17455 - protein, 10 aa, Homo sapiens
RKRPYEENRG

SEQ ID NO: 17456 - protein, 10 aa, Homo sapiens
RKRPYEENRG

SEQ ID NO: 17457 - protein, 10 aa, Homo sapiens
RKRPYEENRG

SEQ ID NO: 17458 - protein, 23 aa, Homo sapiens
RTPTTQETDGFQVKRPGDLSVRC

SEQ ID NO: 17459 - protein, 23 aa, Homo sapiens
RTPTTQETDGFQVKRPGDLSVRC

SEQ ID NO: 17460 - protein, 23 aa, Homo sapiens
RTPTTQETDGFQVKRPGDLSVRC

SEQ ID NO: 17461 - protein, 11 aa, Homo sapiens
KETERIEKERM

SEQ ID NO: 17462 - protein, 10 aa, Homo sapiens
KLIDQKKDRR

SEQ ID NO: 17463 - protein, 18 aa, Homo sapiens
RLMAEDEEGYRKLIDQKK

SEQ ID NO: 17464 - protein, 10 aa, Homo sapiens
KKVMATIEKV

SEQ ID NO: 17465 - protein, 8 aa, Homo sapiens
RAKDDIKK

SEQ ID NO: 17466 - protein, 10 aa, Homo sapiens
KKVMATIEKV

SEQ ID NO: 17467 - protein, 9 aa, Homo sapiens
RAKDDIKKV

SEQ ID NO: 17468 - protein, 14 aa, Homo sapiens
KIVKKNNLFVVDRS

SEQ ID NO: 17469 - protein, 14 aa, Homo sapiens
KIVKKNNLFVVDRS

SEQ ID NO: 17470 - protein, 14 aa, Homo sapiens
KIVKKNNLFVVDRS

SEQ ID NO: 17471 - protein, 11 aa, Homo sapiens
KKNNLFVVDRS

SEQ ID NO: 17472 - protein, 11 aa, Homo sapiens
KKNNLFVVDRS

SEQ ID NO: 17473 - protein, 12 aa, Homo sapiens
RNIKLLEDEPRS

SEQ ID NO: 17474 - protein, 12 aa, Homo sapiens
RNIKLLEDEPRS

SEQ ID NO: 17475 - protein, 12 aa, Homo sapiens
RNIKLLEDEPRS

SEQ ID NO: 17476 - protein, 16 aa, Homo sapiens
RMPYEPNKDPFGGMRK

SEQ ID NO: 17477 - protein, 16 aa, Homo sapiens
RMPYEPNKDPFGGMRK

SEQ ID NO: 17478 - protein, 16 aa, Homo sapiens
RMPYEPNKDPFGGMRK

SEQ ID NO: 17479 - protein, 16 aa, Homo sapiens
RMPYEPNKDPFGGMRK

SEQ ID NO: 17480 - protein, 16 aa, Homo sapiens
RMPYEPNKDPFGGMRK

SEQ ID NO: 17481 - protein, 16 aa, Homo sapiens
RMPYEPNKDPFGGMRK

SEQ ID NO: 17482 - protein, 16 aa, Homo sapiens
RMPYEPNKDPFGGMRK

SEQ ID NO: 17483 - protein, 23 aa, Homo sapiens
RMPTTQETDGFQVKRPGDLNVKC

SEQ ID NO: 17484 - protein, 23 aa, Homo sapiens
RMPTTQETDGFQVKRPGDLNVKC

SEQ ID NO: 17485 - protein, 23 aa, Homo sapiens
RMPTTQETDGFQVKRPGDLNVKC

SEQ ID NO: 17486 - protein, 23 aa, Homo sapiens
RMPTTQETDGFQVKRPGDLNVKC

SEQ ID NO: 17487 - protein, 16 aa, Homo sapiens
RMPTTQETDGFQVKRP

SEQ ID NO: 17488 - protein, 16 aa, Homo sapiens
RMPTTQETDGFQVKRP

SEQ ID NO: 17489 - protein, 16 aa, Homo sapiens
RMPTTQETDGFQVKRP

SEQ ID NO: 17490 - protein, 16 aa, Homo sapiens
RMPTTQETDGFQVKRP

SEQ ID NO: 17491 - protein, 16 aa, Homo sapiens
RMPTTQETDGFQVKRP

SEQ ID NO: 17492 - protein, 16 aa, Homo sapiens
RMPTTQETDGFQVKRP

SEQ ID NO: 17493 - protein, 23 aa, Homo sapiens
RMPTTQETDGFQVKRPGDLNVKC

SEQ ID NO: 17494 - protein, 23 aa, Homo sapiens
RMPTTQETDGFQVKRPGDLNVKC

SEQ ID NO: 17495 - protein, 23 aa, Homo sapiens
RMPTTQETDGFQVKRPGDLNVKC

SEQ ID NO: 17496 - protein, 23 aa, Homo sapiens
RMPTTQETDGFQVKRPGDLNVKC

SEQ ID NO: 17497 - protein, 23 aa, Homo sapiens
RMPTTQETDGFQVKRPGDLNVKC

SEQ ID NO: 17498 - protein, 23 aa, Homo sapiens
RMPTTQETDGFQVKRPGDLNVKC

SEQ ID NO: 17499 - protein, 40 aa, Homo sapiens; identical to SEQ ID NO: 5831

SEQ ID NO: 17500 - protein, 23 aa, Homo sapiens
RMPTTQETDGFQVKRPGDLNVKC

SEQ ID NO: 17501 - protein, 23 aa, Homo sapiens
RMPTTQETDGFQVKRPGDLNVKC

SEQ ID NO: 17502 - protein, 28 aa, Homo sapiens
KLAGLLQHPDPIVINHVISVDPNDQKKT

SEQ ID NO: 17503 - protein, 28 aa, Homo sapiens
KLAGLLQHPDPIVINHVISVDPNDQKKT

SEQ ID NO: 17504 - protein, 8 aa, Homo sapiens
KPLTQKRK

SEQ ID NO: 17505 - protein, 8 aa, Homo sapiens
KPLTQKRK

SEQ ID NO: 17506 - protein, 9 aa, Homo sapiens
KKPLTQKRK

SEQ ID NO: 17507 - protein, 13 aa, Homo sapiens
RVEGKLLDDPSKQ

SEQ ID NO: 17508 - protein, 13 aa, Homo sapiens
RVEGKLLDDPSKQ

SEQ ID NO: 17509 - protein, 16 aa, Homo sapiens
KFLESTDSFNNELKRL

SEQ ID NO: 17510 - protein, 14 aa, Homo sapiens
RLCGLKVEVDMEKI

SEQ ID NO: 17511 - protein, 16 aa, Homo sapiens
KFLESTDSFNNELKRL

SEQ ID NO: 17512 - protein, 16 aa, Homo sapiens
KFLESTDSFNNELKRL

SEQ ID NO: 17513 - protein, 27 aa, Homo sapiens
RLCGLKVEVDMEKIAAEIAQAEEQARK

SEQ ID NO: 17514 - protein, 16 aa, Homo sapiens
KFLESTDSFNNELKRL

SEQ ID NO: 17515 - protein, 16 aa, Homo sapiens
KFLESTDSFNNELKRL

SEQ ID NO: 17516 - protein, 16 aa, Homo sapiens
KFLESTDSFNNELKRL

SEQ ID NO: 17517 - protein, 27 aa, Homo sapiens
RLCGLKVEVDMEKIAAEIAQAEEQARK

SEQ ID NO: 17518 - protein, 16 aa, Homo sapiens
KFLESTDSFNNELKRL

SEQ ID NO: 17519 - protein, 16 aa, Homo sapiens
KFLESTDSFNNELKRL

SEQ ID NO: 17520 - protein, 16 aa, Homo sapiens
KFLESTDSFNNELKRL

SEQ ID NO: 17521 - protein, 16 aa, Homo sapiens
KFLESTDSFNNELKRL

SEQ ID NO: 17522 - protein, 14 aa, Homo sapiens
RLCGLKVEVDMEKI

SEQ ID NO: 17523 - protein, 21 aa, Homo sapiens
KVWDQVKASNPDLKLWEIGKI

SEQ ID NO: 17524 - protein, 18 aa, Homo sapiens
KKTGQPEELVSCSDCGRS

SEQ ID NO: 17525 - protein, 21 aa, Homo sapiens
KINKKTGQPEELVSCSDCGRS

SEQ ID NO: 17526 - protein, 8 aa, Homo sapiens
RGKGKSKG

SEQ ID NO: 17527 - protein, 18 aa, Homo sapiens
KKTGQPEELVSCSDCGRS

SEQ ID NO: 17528 - protein, 18 aa, Homo sapiens
KKTGQPEELVSCSDCGRS

SEQ ID NO: 17529 - protein, 18 aa, Homo sapiens
KKTGQPEELVSCSDCGRS

SEQ ID NO: 17530 - protein, 13 aa, Homo sapiens
KEKASIYQNQNSS

SEQ ID NO: 17531 - protein, 10 aa, Homo sapiens
RSEEQKSKKG

SEQ ID NO: 17532 - protein, 10 aa, Homo sapiens
RSEEQKSKKG

SEQ ID NO: 17533 - protein, 9 aa, Homo sapiens
RSEEQKSKK

SEQ ID NO: 17534 - protein, 23 aa, Homo sapiens
KKGPDGLALPNNYCDFCLGDSKI

SEQ ID NO: 17535 - protein, 9 aa, Homo sapiens
RSEEQKSKK

SEQ ID NO: 17536 - protein, 23 aa, Homo sapiens
KKGPDGLALPNNYCDFCLGDSKI

SEQ ID NO: 17537 - protein, 23 aa, Homo sapiens
KKGPDGLALPNNYCDFCLGDSKI

SEQ ID NO: 17538 - protein, 23 aa, Homo sapiens
KKGPDGLALPNNYCDFCLGDSKI

SEQ ID NO: 17539 - protein, 10 aa, Homo sapiens
KGKGVGSARK

SEQ ID NO: 17540 - protein, 9 aa, Homo sapiens
RTDPLEKRG

SEQ ID NO: 17541 - protein, 9 aa, Homo sapiens
RTDPLEKRG

SEQ ID NO: 17542 - protein, 19 aa, Homo sapiens
KKEGLISQDGSSLEALLRT

SEQ ID NO: 17543 - protein, 17 aa, Homo sapiens
RLSFPSIKPDTDQTLKK

SEQ ID NO: 17544 - protein, 10 aa, Homo sapiens
KGKGVGSARK

SEQ ID NO: 17545 - protein, 7 aa, Homo sapiens
RRGKGKS

SEQ ID NO: 17546 - protein, 7 aa, Homo sapiens
RRGKGKS

SEQ ID NO: 17547 - protein, 10 aa, Homo sapiens
RTLFQLKQRR

SEQ ID NO: 17548 - protein, 10 aa, Homo sapiens
RTLFQLKQRR

SEQ ID NO: 17549 - protein, 10 aa, Homo sapiens
KDAGSYSKKV

SEQ ID NO: 17550 - protein, 25 aa, Homo sapiens
RVAPEEHPVLLTEAPLNPKANREKM

SEQ ID NO: 17551 - protein, 23 aa, Homo sapiens
RVAPEEHPVLLTEAPLNPKANRE

SEQ ID NO: 17552 - protein, 11 aa, Homo sapiens
KIKIIAPPERK

SEQ ID NO: 17553 - protein, 11 aa, Homo sapiens
KIKIIAPPERK

SEQ ID NO: 17554 - protein, 12 aa, Homo sapiens
KIKIIAPPERKY

SEQ ID NO: 17555 - protein, 11 aa, Homo sapiens
KIKIIAPPERK

SEQ ID NO: 17556 - protein, 24 aa, Homo sapiens
RKDLYANTVLSGGTTMYPGIADRM

SEQ ID NO: 17557 - protein, 12 aa, Homo sapiens
KIKIIAPPERKY

SEQ ID NO: 17558 - protein, 24 aa, Homo sapiens
RKDLYANTVLSGGTTMYPGIADRM

SEQ ID NO: 17559 - protein, 11 aa, Homo sapiens
KIKIIAPPERK

SEQ ID NO: 17560 - protein, 11 aa, Homo sapiens
KIKIIAPPERK

SEQ ID NO: 17561 - protein, 24 aa, Homo sapiens
RKDLYANTVLSGGTTMYPGIADRM

SEQ ID NO: 17562 - protein, 30 aa, Homo sapiens; identical to SEQ ID NO: 16416

SEQ ID NO: 17563 - protein, 12 aa, Homo sapiens
KIKIIAPPERKY

SEQ ID NO: 17564 - protein, 11 aa, Homo sapiens
KIKIIAPPERK

SEQ ID NO: 17565 - protein, 24 aa, Homo sapiens
RKDLYANTVLSGGTTMYPGIADRM

SEQ ID NO: 17566 - protein, 24 aa, Homo sapiens
RKDLYANTVLSGGTTMYPGIADRM

SEQ ID NO: 17567 - protein, 24 aa, Homo sapiens
RKDLYANTVLSGGTTMYPGIADRM

SEQ ID NO: 17568 - protein, 11 aa, Homo sapiens
KIKIIAPPERK

SEQ ID NO: 17569 - protein, 11 aa, Homo sapiens
KIKIIAPPERK

SEQ ID NO: 17570 - protein, 30 aa, Homo sapiens; identical to SEQ ID NO: 16416

SEQ ID NO: 17571 - protein, 11 aa, Homo sapiens
KIKIIAPPERK

SEQ ID NO: 17572 - protein, 11 aa, Homo sapiens
KIKIIAPPERK

SEQ ID NO: 17573 - protein, 11 aa, Homo sapiens
KIKIIAPPERK

SEQ ID NO: 17574 - protein, 18 aa, Homo sapiens
RMQKEITALAPSTMKIKI

SEQ ID NO: 17575 - protein, 18 aa, Homo sapiens
RMQKEITALAPSTMKIKI

SEQ ID NO: 17576 - protein, 18 aa, Homo sapiens
RMQKEITALAPSTMKIKI

SEQ ID NO: 17577 - protein, 18 aa, Homo sapiens
RMQKEITALAPSTMKIKI

SEQ ID NO: 17578 - protein, 15 aa, Homo sapiens
KEITALAPSTMKIKI

SEQ ID NO: 17579 - protein, 15 aa, Homo sapiens
KEITALAPSTMKIKI

SEQ ID NO: 17580 - protein, 18 aa, Homo sapiens
RMQKEITALAPSTMKIKI

SEQ ID NO: 17581 - protein, 24 aa, Homo sapiens
RKDLYANTVLSGGTTMYPGIADRM

SEQ ID NO: 17582 - protein, 30 aa, Homo sapiens; identical to SEQ ID NO: 16416

SEQ ID NO: 17583 - protein, 30 aa, Homo sapiens; identical to SEQ ID NO: 16416

SEQ ID NO: 17584 - protein, 18 aa, Homo sapiens
RMQKEITALAPSTMKIKI

SEQ ID NO: 17585 - protein, 24 aa, Homo sapiens
RKDLYANTVLSGGTTMYPGIADRM

SEQ ID NO: 17586 - protein, 7 aa, Homo sapiens
TDMYTKK

SEQ ID NO: 17587 - protein, 14 aa, Homo sapiens
NVPSKSKAAASATR

SEQ ID NO: 17588 - protein, 12 aa, Homo sapiens
TDMYTKKNVPSK

SEQ ID NO: 17589 - protein, 12 aa, Homo sapiens
TDMYTKKNVPSK

SEQ ID NO: 17590 - protein, 12 aa, Homo sapiens
TDMYTKKNVPSK

SEQ ID NO: 17591 - protein, 15 aa, Homo sapiens
MKEEVPTALVEAHVR

SEQ ID NO: 17592 - protein, 5 aa, Homo sapiens
TKVER

SEQ ID NO: 17593 - protein, 23 aa, Homo sapiens
SALEEFSKMKEEVPTALVEAHVR

SEQ ID NO: 17594 - protein, 7 aa, Homo sapiens
KVEEAAK

SEQ ID NO: 17595 - protein, 7 aa, Homo sapiens
KVEEAAK

SEQ ID NO: 17596 - protein, 15 aa, Homo sapiens
MKEEVPTALVEAHVR

SEQ ID NO: 17597 - protein, 15 aa, Homo sapiens
MKEEVPTALVEAHVR

SEQ ID NO: 17598 - protein, 15 aa, Homo sapiens
MKEEVPTALVEAHVR

SEQ ID NO: 17599 - protein, 11 aa, Homo sapiens
SKTPEIYLAYR

SEQ ID NO: 17600 - protein, 12 aa, Homo sapiens
RALPEFFNGKNK

SEQ ID NO: 17601 - protein, 6 aa, Homo sapiens
KNVPSK

SEQ ID NO: 17602 - protein, 30 aa, Homo sapiens; identical to SEQ ID NO: 8343

SEQ ID NO: 17603 - protein, 14 aa, Homo sapiens
TVNTKKDSESAPVK

SEQ ID NO: 17604 - protein, 14 aa, Homo sapiens
TVNTKKDSESAPVK

SEQ ID NO: 17605 - protein, 14 aa, Homo sapiens
TVNTKKDSESAPVK

SEQ ID NO: 17606 - protein, 14 aa, Homo sapiens
TVNTKKDSESAPVK

SEQ ID NO: 17607 - protein, 30 aa, Homo sapiens; identical to SEQ ID NO: 8343

SEQ ID NO: 17608 - protein, 14 aa, Homo sapiens
TVNTKKDSESAPVK

SEQ ID NO: 17609 - protein, 14 aa, Homo sapiens
TVNTKKDSESAPVK

SEQ ID NO: 17610 - protein, 14 aa, Homo sapiens
TVNTKKDSESAPVK

SEQ ID NO: 17611 - protein, 6 aa, Homo sapiens
KTKVER

SEQ ID NO: 17612 - protein, 6 aa, Homo sapiens
KTKVER

SEQ ID NO: 17613 - protein, 6 aa, Homo sapiens
KTKVER

SEQ ID NO: 17614 - protein, 11 aa, Homo sapiens
KVEEAAKVTGK

SEQ ID NO: 17615 - protein, 5 aa, Homo sapiens
TKVER

SEQ ID NO: 17616 - protein, 6 aa, Homo sapiens
LKDIIK

SEQ ID NO: 17617 - protein, 6 aa, Homo sapiens
KTKVER

SEQ ID NO: 17618 - protein, 6 aa, Homo sapiens
KTKVER

SEQ ID NO: 17619 - protein, 15 aa, Homo sapiens
VASAAAKSALEEFSK

SEQ ID NO: 17620 - protein, 5 aa, Homo sapiens
TKVER

SEQ ID NO: 17621 - protein, 10 aa, Homo sapiens
AKHLAAVEER

SEQ ID NO: 17622 - protein, 10 aa, Homo sapiens
AKHLAAVEER

SEQ ID NO: 17623 - protein, 10 aa, Homo sapiens
AKHLAAVEER

SEQ ID NO: 17624 - protein, 9 aa, Homo sapiens
KDSESAPVK

SEQ ID NO: 17625 - protein, 7 aa, Homo sapiens
KVEEAAK

SEQ ID NO: 17626 - protein, 6 aa, Homo sapiens
KTKVER

SEQ ID NO: 17627 - protein, 6 aa, Homo sapiens
KTKVER

SEQ ID NO: 17628 - protein, 7 aa, Homo sapiens
KVEEAAK

SEQ ID NO: 17629 - protein, 14 aa, Homo sapiens
GKEKPTDMQNFGLR

SEQ ID NO: 17630 - protein, 14 aa, Homo sapiens
GKEKPTDMQNFGLR

SEQ ID NO: 17631 - protein, 8 aa, Homo sapiens
DKKGGNYK

SEQ ID NO: 17632 - protein, 9 aa, Homo sapiens
KKDGGPNVK

SEQ ID NO: 17633 - protein, 18 aa, Homo sapiens
EGQEEVLKEVVESEGERK

SEQ ID NO: 17634 - protein, 26 aa, Homo sapiens
TKVERDIGEGNLSTAAAAALAAAAVK

SEQ ID NO: 17635 - protein, 18 aa, Homo sapiens
EGQEEVLKEVVESEGERK

SEQ ID NO: 17636 - protein, 17 aa, Homo sapiens
EGQEEVLKEVVESEGER

SEQ ID NO: 17637 - protein, 17 aa, Homo sapiens
EGQEEVLKEVVESEGER

SEQ ID NO: 17638 - protein, 6 aa, Homo sapiens
KTKVER

SEQ ID NO: 17639 - protein, 6 aa, Homo sapiens
KTKVER

SEQ ID NO: 17640 - protein, 11 aa, Homo sapiens
KYIQAEPPTNK

SEQ ID NO: 17641 - protein, 12 aa, Homo sapiens
EKPTDMQNFGLR

SEQ ID NO: 17642 - protein, 19 aa, Homo sapiens
TPQQTSASQQMLNFPDKGK

SEQ ID NO: 17643 - protein, 12 aa, Homo sapiens
EKPTDMQNFGLR

SEQ ID NO: 17644 - protein, 12 aa, Homo sapiens
EKPTDMQNFGLR

SEQ ID NO: 17645 - protein, 19 aa, Homo sapiens
TPQQTSASQQMLNFPDKGK

SEQ ID NO: 17646 - protein, 19 aa, Homo sapiens
TPQQTSASQQMLNFPDKGK

SEQ ID NO: 17647 - protein, 19 aa, Homo sapiens
TPQQTSASQQMLNFPDKGK

SEQ ID NO: 17648 - protein, 19 aa, Homo sapiens
TPQQTSASQQMLNFPDKGK

SEQ ID NO: 17649 - protein, 19 aa, Homo sapiens
TPQQTSASQQMLNFPDKGK

SEQ ID NO: 17650 - protein, 19 aa, Homo sapiens
TPQQTSASQQMLNFPDKGK

SEQ ID NO: 17651 - protein, 12 aa, Homo sapiens
EKPTDMQNFGLR

SEQ ID NO: 17652 - protein, 6 aa, Homo sapiens
KTKVER

SEQ ID NO: 17653 - protein, 6 aa, Homo sapiens
KTKVER

SEQ ID NO: 17654 - protein, 5 aa, Homo sapiens
TKVER

SEQ ID NO: 17655 - protein, 16 aa, Homo sapiens
DLKTMTDVVGNPEEER

SEQ ID NO: 17656 - protein, 19 aa, Homo sapiens
KRPAPQQIQQVQQQAVQNR

SEQ ID NO: 17657 - protein, 21 aa, Homo sapiens
TATTQETDGFQVKRPGDVNVR

SEQ ID NO: 17658 - protein, 21 aa, Homo sapiens
TATTQETDGFQVKRPGDVNVR

SEQ ID NO: 17659 - protein, 21 aa, Homo sapiens
TATTQETDGFQVKRPGDVNVR

SEQ ID NO: 17660 - protein, 21 aa, Homo sapiens
TATTQETDGFQVKRPGDVNVR

SEQ ID NO: 17661 - protein, 21 aa, Homo sapiens
TATTQETDGFQVKRPGDVNVR

SEQ ID NO: 17662 - protein, 21 aa, Homo sapiens
TATTQETDGFQVKRPGDVNVR

SEQ ID NO: 17663 - protein, 21 aa, Homo sapiens
TATTQETDGFQVKRPGDVNVR

SEQ ID NO: 17664 - protein, 21 aa, Homo sapiens
TATTQETDGFQVKRPGDVNVR

SEQ ID NO: 17665 - protein, 21 aa, Homo sapiens
TATTQETDGFQVKRPGDVNVR

SEQ ID NO: 17666 - protein, 21 aa, Homo sapiens
TATTQETDGFQVKRPGDVNVR

SEQ ID NO: 17667 - protein, 21 aa, Homo sapiens
TATTQETDGFQVKRPGDVNVR

SEQ ID NO: 17668 - protein, 21 aa, Homo sapiens
TATTQETDGFQVKRPGDVNVR

SEQ ID NO: 17669 - protein, 21 aa, Homo sapiens
TATTQETDGFQVKRPGDVNVR

SEQ ID NO: 17670 - protein, 21 aa, Homo sapiens
TATTQETDGFQVKRPGDVNVR

SEQ ID NO: 17671 - protein, 21 aa, Homo sapiens
TATTQETDGFQVKRPGDVNVR

SEQ ID NO: 17672 - protein, 21 aa, Homo sapiens
TATTQETDGFQVKRPGDVNVR

SEQ ID NO: 17673 - protein, 21 aa, Homo sapiens
TATTQETDGFQVKRPGDVNVR

SEQ ID NO: 17674 - protein, 21 aa, Homo sapiens
TATTQETDGFQVKRPGDVNVR

SEQ ID NO: 17675 - protein, 21 aa, Homo sapiens
TATTQETDGFQVKRPGDVNVR

SEQ ID NO: 17676 - protein, 21 aa, Homo sapiens
TATTQETDGFQVKRPGDVNVR

SEQ ID NO: 17677 - protein, 21 aa, Homo sapiens
TATTQETDGFQVKRPGDVNVR

SEQ ID NO: 17678 - protein, 6 aa, Homo sapiens
PIKQKR

SEQ ID NO: 17679 - protein, 5 aa, Homo sapiens
PIKQK

SEQ ID NO: 17680 - protein, 6 aa, Homo sapiens
PIKQKR

SEQ ID NO: 17681 - protein, 10 aa, Homo sapiens
KMADKILPQR

SEQ ID NO: 17682 - protein, 9 aa, Homo sapiens
KGQASLYGK

SEQ ID NO: 17683 - protein, 10 aa, Homo sapiens
KGQASLYGKR

SEQ ID NO: 17684 - protein, 14 aa, Homo sapiens
NVNLKKDSENTPVK

SEQ ID NO: 17685 - protein, 14 aa, Homo sapiens
NVNLKKDSENTPVK

SEQ ID NO: 17686 - protein, 14 aa, Homo sapiens
NVNLKKDSENTPVK

SEQ ID NO: 17687 - protein, 7 aa, Homo sapiens
KASANAR

SEQ ID NO: 17688 - protein, 7 aa, Homo sapiens
KASANAR

SEQ ID NO: 17689 - protein, 7 aa, Homo sapiens
KASANAR

SEQ ID NO: 17690 - protein, 9 aa, Homo sapiens
KGQASLYGK

SEQ ID NO: 17691 - protein, 7 aa, Homo sapiens
KASANAR

SEQ ID NO: 17692 - protein, 9 aa, Homo sapiens
RKDGGPATK

SEQ ID NO: 17693 - protein, 7 aa, Homo sapiens
KASANAR

SEQ ID NO: 17694 - protein, 7 aa, Homo sapiens
KASANAR

SEQ ID NO: 17695 - protein, 7 aa, Homo sapiens
KASANAR

SEQ ID NO: 17696 - protein, 7 aa, Homo sapiens
KASANAR

SEQ ID NO: 17697 - protein, 7 aa, Homo sapiens
KASANAR

SEQ ID NO: 17698 - protein, 7 aa, Homo sapiens
KASANAR

SEQ ID NO: 17699 - protein, 7 aa, Homo sapiens
KASANAR

SEQ ID NO: 17700 - protein, 7 aa, Homo sapiens
KASANAR

SEQ ID NO: 17701 - protein, 7 aa, Homo sapiens
KASANAR

SEQ ID NO: 17702 - protein, 7 aa, Homo sapiens
KASANAR

SEQ ID NO: 17703 - protein, 7 aa, Homo sapiens
ESDTGKK

SEQ ID NO: 17704 - protein, 7 aa, Homo sapiens
ESDTGKK

SEQ ID NO: 17705 - protein, 7 aa, Homo sapiens
ESDTGKK

SEQ ID NO: 17706 - protein, 7 aa, Homo sapiens
ESDTGKK

SEQ ID NO: 17707 - protein, 7 aa, Homo sapiens
ESDTGKK

SEQ ID NO: 17708 - protein, 9 aa, Homo sapiens
ERESDTGKK

SEQ ID NO: 17709 - protein, 16 aa, Homo sapiens
VREEVPLELVEAHVKK

SEQ ID NO: 17710 - protein, 14 aa, Homo sapiens
NVNLKKDSENTPVK

SEQ ID NO: 17711 - protein, 14 aa, Homo sapiens
NVNLKKDSENTPVK

SEQ ID NO: 17712 - protein, 7 aa, Homo sapiens
ESDTGKK

SEQ ID NO: 17713 - protein, 8 aa, Homo sapiens
ESDTGKKK

SEQ ID NO: 17714 - protein, 15 aa, Homo sapiens
VASAAAKAALEEFSR

SEQ ID NO: 17715 - protein, 15 aa, Homo sapiens
VASAAAKAALEEFSR

SEQ ID NO: 17716 - protein, 15 aa, Homo sapiens
VASAAAKAALEEFSR

SEQ ID NO: 17717 - protein, 7 aa, Homo sapiens
KVQEAAR

SEQ ID NO: 17718 - protein, 15 aa, Homo sapiens
VASAAAKAALEEFSR

SEQ ID NO: 17719 - protein, 15 aa, Homo sapiens
VASAAAKAALEEFSR

SEQ ID NO: 17720 - protein, 8 aa, Homo sapiens
KDGGPATK

SEQ ID NO: 17721 - protein, 9 aa, Homo sapiens
DRKASANAR

SEQ ID NO: 17722 - protein, 7 aa, Homo sapiens
KASANAR

SEQ ID NO: 17723 - protein, 7 aa, Homo sapiens
KVQEAAR

SEQ ID NO: 17724 - protein, 18 aa, Homo sapiens
SPQVPAAQQMLNFPEKNK

SEQ ID NO: 17725 - protein, 18 aa, Homo sapiens
EKPVDLQNFGLRTDIYSK

SEQ ID NO: 17726 - protein, 12 aa, Homo sapiens
EKPVDLQNFGLR

SEQ ID NO: 17727 - protein, 18 aa, Homo sapiens
EKPVDLQNFGLRTDIYSK

SEQ ID NO: 17728 - protein, 18 aa, Homo sapiens
SPQVPAAQQMLNFPEKNK

SEQ ID NO: 17729 - protein, 12 aa, Homo sapiens
EKPVDLQNFGLR

SEQ ID NO: 17730 - protein, 18 aa, Homo sapiens
SPQVPAAQQMLNFPEKNK

SEQ ID NO: 17731 - protein, 12 aa, Homo sapiens
EKPVDLQNFGLR

SEQ ID NO: 17732 - protein, 18 aa, Homo sapiens
SPQVPAAQQMLNFPEKNK

SEQ ID NO: 17733 - protein, 18 aa, Homo sapiens
SPQVPAAQQMLNFPEKNK

SEQ ID NO: 17734 - protein, 12 aa, Homo sapiens
EKPVDLQNFGLR

SEQ ID NO: 17735 - protein, 12 aa, Homo sapiens
EKPVDLQNFGLR

SEQ ID NO: 17736 - protein, 18 aa, Homo sapiens
SPQVPAAQQMLNFPEKNK

SEQ ID NO: 17737 - protein, 18 aa, Homo sapiens
SPQVPAAQQMLNFPEKNK

SEQ ID NO: 17738 - protein, 18 aa, Homo sapiens
SPQVPAAQQMLNFPEKNK

SEQ ID NO: 17739 - protein, 18 aa, Homo sapiens
SPQVPAAQQMLNFPEKNK

SEQ ID NO: 17740 - protein, 18 aa, Homo sapiens
SPQVPAAQQMLNFPEKNK

SEQ ID NO: 17741 - protein, 20 aa, Homo sapiens
SPQVPAAQQMLNFPEKNKEK

SEQ ID NO: 17742 - protein, 18 aa, Homo sapiens
SPQVPAAQQMLNFPEKNK

SEQ ID NO: 17743 - protein, 18 aa, Homo sapiens
SPQVPAAQQMLNFPEKNK

SEQ ID NO: 17744 - protein, 18 aa, Homo sapiens
EKPVDLQNFGLRTDIYSK

SEQ ID NO: 17745 - protein, 18 aa, Homo sapiens
SPQVPAAQQMLNFPEKNK

SEQ ID NO: 17746 - protein, 18 aa, Homo sapiens
SPQVPAAQQMLNFPEKNK

SEQ ID NO: 17747 - protein, 18 aa, Homo sapiens
SPQVPAAQQMLNFPEKNK

SEQ ID NO: 17748 - protein, 18 aa, Homo sapiens
SPQVPAAQQMLNFPEKNK

SEQ ID NO: 17749 - protein, 18 aa, Homo sapiens
SPQVPAAQQMLNFPEKNK

SEQ ID NO: 17750 - protein, 18 aa, Homo sapiens
SPQVPAAQQMLNFPEKNK

SEQ ID NO: 17751 - protein, 18 aa, Homo sapiens
SPQVPAAQQMLNFPEKNK

SEQ ID NO: 17752 - protein, 18 aa, Homo sapiens
SPQVPAAQQMLNFPEKNK

SEQ ID NO: 17753 - protein, 18 aa, Homo sapiens
SPQVPAAQQMLNFPEKNK

SEQ ID NO: 17754 - protein, 18 aa, Homo sapiens
EKPVDLQNFGLRTDIYSK

SEQ ID NO: 17755 - protein, 12 aa, Homo sapiens
EKPVDLQNFGLR

SEQ ID NO: 17756 - protein, 18 aa, Homo sapiens
SPQVPAAQQMLNFPEKNK

SEQ ID NO: 17757 - protein, 18 aa, Homo sapiens
SPQVPAAQQMLNFPEKNK

SEQ ID NO: 17758 - protein, 18 aa, Homo sapiens
SPQVPAAQQMLNFPEKNK

SEQ ID NO: 17759 - protein, 18 aa, Homo sapiens
SPQVPAAQQMLNFPEKNK

SEQ ID NO: 17760 - protein, 12 aa, Homo sapiens
EKPVDLQNFGLR

SEQ ID NO: 17761 - protein, 12 aa, Homo sapiens
EKPVDLQNFGLR

SEQ ID NO: 17762 - protein, 12 aa, Homo sapiens
EKPVDLQNFGLR

SEQ ID NO: 17763 - protein, 34 aa, Homo sapiens; identical to SEQ ID NO: 8864

SEQ ID NO: 17764 - protein, 34 aa, Homo sapiens; identical to SEQ ID NO: 8864

SEQ ID NO: 17765 - protein, 7 aa, Homo sapiens
KVQEAAR

SEQ ID NO: 17766 - protein, 32 aa, Homo sapiens; identical to SEQ ID NO: 16574

SEQ ID NO: 17767 - protein, 14 aa, Homo sapiens
NVNLKKDSENTPVK

SEQ ID NO: 17768 - protein, 11 aa, Homo sapiens
TDIYSKKTLAK

SEQ ID NO: 17769 - protein, 12 aa, Homo sapiens
TLAKSKGASAGR

SEQ ID NO: 17770 - protein, 6 aa, Homo sapiens
TLAKSK

SEQ ID NO: 17771 - protein, 7 aa, Homo sapiens
TDIYSKK

SEQ ID NO: 17772 - protein, 14 aa, Homo sapiens
MSYEPNKDPYGSMR

SEQ ID NO: 17773 - protein, 14 aa, Homo sapiens
MSYEPNKDPYGSMR

SEQ ID NO: 17774 - protein, 14 aa, Homo sapiens
MSYEPNKDPYGSMR

SEQ ID NO: 17775 - protein, 14 aa, Homo sapiens
MSYEPNKDPYGSMR

SEQ ID NO: 17776 - protein, 14 aa, Homo sapiens
MSYEPNKDPYGSMR

SEQ ID NO: 17777 - protein, 21 aa, Homo sapiens
SNSVGIQDAFNDGSDSTFQKR

SEQ ID NO: 17778 - protein, 21 aa, Homo sapiens
SNSVGIQDAFNDGSDSTFQKR

SEQ ID NO: 17779 - protein, 21 aa, Homo sapiens
SNSVGIQDAFNDGSDSTFQKR

SEQ ID NO: 17780 - protein, 25 aa, Homo sapiens
KAPGSDPFMSSGQGPNGGMGDPYSR

SEQ ID NO: 17781 - protein, 10 aa, Homo sapiens
LEKLYSTMVR

SEQ ID NO: 17782 - protein, 10 aa, Homo sapiens
LEKLYSTMVR

SEQ ID NO: 17783 - protein, 10 aa, Homo sapiens
LEKLYSTMVR

SEQ ID NO: 17784 - protein, 15 aa, Homo sapiens
DKPASENSEEKLISK

SEQ ID NO: 17785 - protein, 7 aa, Homo sapiens
FDKLPVK

SEQ ID NO: 17786 - protein, 7 aa, Homo sapiens
FDKLPVK

SEQ ID NO: 17787 - protein, 11 aa, Homo sapiens
FDKLPVKIVQK

SEQ ID NO: 17788 - protein, 14 aa, Homo sapiens
MSYEPNKDPYGSMR

SEQ ID NO: 17789 - protein, 14 aa, Homo sapiens
MSYEPNKDPYGSMR

SEQ ID NO: 17790 - protein, 25 aa, Homo sapiens
KAPGSDPFMSSGQGPNGGMGDPYSR

SEQ ID NO: 17791 - protein, 14 aa, Homo sapiens
MSYEPNKDPYGSMR

SEQ ID NO: 17792 - protein, 25 aa, Homo sapiens
KAPGSDPFMSSGQGPNGGMGDPYSR

SEQ ID NO: 17793 - protein, 25 aa, Homo sapiens
KAPGSDPFMSSGQGPNGGMGDPYSR

SEQ ID NO: 17794 - protein, 25 aa, Homo sapiens
KAPGSDPFMSSGQGPNGGMGDPYSR

SEQ ID NO: 17795 - protein, 14 aa, Homo sapiens
MSYEPNKDPYGSMR

SEQ ID NO: 17796 - protein, 14 aa, Homo sapiens
MSYEPNKDPYGSMR

SEQ ID NO: 17797 - protein, 25 aa, Homo sapiens
KAPGSDPFMSSGQGPNGGMGDPYSR

SEQ ID NO: 17798 - protein, 25 aa, Homo sapiens
KAPGSDPFMSSGQGPNGGMGDPYSR

SEQ ID NO: 17799 - protein, 25 aa, Homo sapiens
KAPGSDPFMSSGQGPNGGMGDPYSR

SEQ ID NO: 17800 - protein, 25 aa, Homo sapiens
KAPGSDPFMSSGQGPNGGMGDPYSR

SEQ ID NO: 17801 - protein, 14 aa, Homo sapiens
MSYEPNKDPYGSMR

SEQ ID NO: 17802 - protein, 25 aa, Homo sapiens
KAPGSDPFMSSGQGPNGGMGDPYSR

SEQ ID NO: 17803 - protein, 25 aa, Homo sapiens
KAPGSDPFMSSGQGPNGGMGDPYSR

SEQ ID NO: 17804 - protein, 25 aa, Homo sapiens
KAPGSDPFMSSGQGPNGGMGDPYSR

SEQ ID NO: 17805 - protein, 25 aa, Homo sapiens
KAPGSDPFMSSGQGPNGGMGDPYSR

SEQ ID NO: 17806 - protein, 25 aa, Homo sapiens
KAPGSDPFMSSGQGPNGGMGDPYSR

SEQ ID NO: 17807 - protein, 25 aa, Homo sapiens
KAPGSDPFMSSGQGPNGGMGDPYSR

SEQ ID NO: 17808 - protein, 14 aa, Homo sapiens
MSYEPNKDPYGSMR

SEQ ID NO: 17809 - protein, 25 aa, Homo sapiens
KAPGSDPFMSSGQGPNGGMGDPYSR

SEQ ID NO: 17810 - protein, 16 aa, Homo sapiens
ESSKFPFGISPAQSHR

SEQ ID NO: 17811 - protein, 16 aa, Homo sapiens
ESSKFPFGISPAQSHR

SEQ ID NO: 17812 - protein, 16 aa, Homo sapiens
ESSKFPFGISPAQSHR

SEQ ID NO: 17813 - protein, 16 aa, Homo sapiens
ESSKFPFGISPAQSHR

SEQ ID NO: 17814 - protein, 27 aa, Homo sapiens
KHVTTAEGTPGTTDQEGPPPDGPPEKR

SEQ ID NO: 17815 - protein, 12 aa, Homo sapiens
LILLHHKHPERK

SEQ ID NO: 17816 - protein, 7 aa, Homo sapiens
KPLDLYR

SEQ ID NO: 17817 - protein, 7 aa, Homo sapiens
KPLDLYR

SEQ ID NO: 17818 - protein, 7 aa, Homo sapiens
KPLDLYR

SEQ ID NO: 17819 - protein, 7 aa, Homo sapiens
KPLDLYR

SEQ ID NO: 17820 - protein, 7 aa, Homo sapiens
KPLDLYR

SEQ ID NO: 17821 - protein, 7 aa, Homo sapiens
KPLDLYR

SEQ ID NO: 17822 - protein, 7 aa, Homo sapiens
KPLDLYR

SEQ ID NO: 17823 - protein, 7 aa, Homo sapiens
KPLDLYR

SEQ ID NO: 17824 - protein, 7 aa, Homo sapiens
KPLDLYR

SEQ ID NO: 17825 - protein, 7 aa, Homo sapiens
KAEQQQR

SEQ ID NO: 17826 - protein, 29 aa, Homo sapiens
NIKILEDEPHSKDETPLCTLLDWQDSLAK

SEQ ID NO: 17827 - protein, 29 aa, Homo sapiens
NIKILEDEPHSKDETPLCTLLDWQDSLAK

SEQ ID NO: 17828 - protein, 25 aa, Homo sapiens
KAPGSDPFMSSGQGPNGGMGDPYSR

SEQ ID NO: 17829 - protein, 8 aa, Homo sapiens
YKDSSSGR

SEQ ID NO: 17830 - protein, 5 aa, Homo sapiens
LKGGR

SEQ ID NO: 17831 - protein, 8 aa, Homo sapiens
YKDSSSGR

SEQ ID NO: 17832 - protein, 8 aa, Homo sapiens
YKDSSSGR

SEQ ID NO: 17833 - protein, 8 aa, Homo sapiens
YKDSSSGR

SEQ ID NO: 17834 - protein, 5 aa, Homo sapiens
LKGGR

SEQ ID NO: 17835 - protein, 11 aa, Homo sapiens
KELPEYYELIR

SEQ ID NO: 17836 - protein, 11 aa, Homo sapiens
KELPEYYELIR

SEQ ID NO: 17837 - protein, 6 aa, Homo sapiens
KPVDFK

SEQ ID NO: 17838 - protein, 10 aa, Homo sapiens
VSYKGSPAAR

SEQ ID NO: 17839 - protein, 10 aa, Homo sapiens
VSYKGSPAAR

SEQ ID NO: 17840 - protein, 10 aa, Homo sapiens
VSYKGSPAAR

SEQ ID NO: 17841 - protein, 8 aa, Homo sapiens
YKLNVDQK

SEQ ID NO: 17842 - protein, 8 aa, Homo sapiens
YKLNVDQK

SEQ ID NO: 17843 - protein, 10 aa, Homo sapiens
VSYKGSPAAR

SEQ ID NO: 17844 - protein, 9 aa, Homo sapiens
ENERIEKER

SEQ ID NO: 17845 - protein, 9 aa, Homo sapiens
ENERIEKER

SEQ ID NO: 17846 - protein, 9 aa, Homo sapiens
ENERIEKER

SEQ ID NO: 17847 - protein, 9 aa, Homo sapiens
ENERIEKER

SEQ ID NO: 17848 - protein, 9 aa, Homo sapiens
ENERIEKER

SEQ ID NO: 17849 - protein, 9 aa, Homo sapiens
ENERIEKER

SEQ ID NO: 17850 - protein, 15 aa, Homo sapiens
AVATYHANTEREQKK

SEQ ID NO: 17851 - protein, 9 aa, Homo sapiens
ENERIEKER

SEQ ID NO: 17852 - protein, 9 aa, Homo sapiens
ENERIEKER

SEQ ID NO: 17853 - protein, 9 aa, Homo sapiens
ENERIEKER

SEQ ID NO: 17854 - protein, 6 aa, Homo sapiens
LIDQKK

SEQ ID NO: 17855 - protein, 8 aa, Homo sapiens
EQKKENER

SEQ ID NO: 17856 - protein, 7 aa, Homo sapiens
IRNHKYR

SEQ ID NO: 17857 - protein, 17 aa, Homo sapiens
GRPPAEKLSPNPPNLTK

SEQ ID NO: 17858 - protein, 5 aa, Homo sapiens
LKGGR

SEQ ID NO: 17859 - protein, 17 aa, Homo sapiens
KKIPDPDSDDVSEVDAR

SEQ ID NO: 17860 - protein, 17 aa, Homo sapiens
KKIPDPDSDDVSEVDAR

SEQ ID NO: 17861 - protein, 16 aa, Homo sapiens
LMAEDEEGYRKLIDQK

SEQ ID NO: 17862 - protein, 16 aa, Homo sapiens
LMAEDEEGYRKLIDQK

SEQ ID NO: 17863 - protein, 16 aa, Homo sapiens
LMAEDEEGYRKLIDQK

SEQ ID NO: 17864 - protein, 4 aa, Homo sapiens
KDKR

SEQ ID NO: 17865 - protein, 16 aa, Homo sapiens
LMAEDEEGYRKLIDQK

SEQ ID NO: 17866 - protein, 8 aa, Homo sapiens
EKAQDRLK

SEQ ID NO: 17867 - protein, 7 aa, Homo sapiens
KEKAQDR

SEQ ID NO: 17868 - protein, 10 aa, Homo sapiens
YNQMKGMGMR

SEQ ID NO: 17869 - protein, 17 aa, Homo sapiens
KKIPDPDSDDVSEVDAR

SEQ ID NO: 17870 - protein, 7 aa, Homo sapiens
KPVDFKK

SEQ ID NO: 17871 - protein, 6 aa, Homo sapiens
KPVDFK

SEQ ID NO: 17872 - protein, 5 aa, Homo sapiens
KIKER

SEQ ID NO: 17873 - protein, 13 aa, Homo sapiens
YLRLDGTTKAEDR

SEQ ID NO: 17874 - protein, 10 aa, Homo sapiens
LDGTTKAEDR

SEQ ID NO: 17875 - protein, 13 aa, Homo sapiens
YLRLDGTTKAEDR

SEQ ID NO: 17876 - protein, 10 aa, Homo sapiens
LDGTTKAEDR

SEQ ID NO: 17877 - protein, 15 aa, Homo sapiens
LDGTTKAEDRGMLLK

SEQ ID NO: 17878 - protein, 10 aa, Homo sapiens
LDGTTKAEDR

SEQ ID NO: 17879 - protein, 15 aa, Homo sapiens
LDGTTKAEDRGMLLK

SEQ ID NO: 17880 - protein, 10 aa, Homo sapiens
LDGTTKAEDR

SEQ ID NO: 17881 - protein, 10 aa, Homo sapiens
LDGTTKAEDR

SEQ ID NO: 17882 - protein, 4 aa, Homo sapiens
KSSR

SEQ ID NO: 17883 - protein, 4 aa, Homo sapiens
KSSR

SEQ ID NO: 17884 - protein, 4 aa, Homo sapiens
KSSR

SEQ ID NO: 17885 - protein, 4 aa, Homo sapiens
KSSR

SEQ ID NO: 17886 - protein, 10 aa, Homo sapiens
VSYKGSPAAR

SEQ ID NO: 17887 - protein, 10 aa, Homo sapiens
VSYKGSPAAR

SEQ ID NO: 17888 - protein, 10 aa, Homo sapiens
VSYKGSPAAR

SEQ ID NO: 17889 - protein, 8 aa, Homo sapiens
QQKIEQER

SEQ ID NO: 17890 - protein, 7 aa, Homo sapiens
ITEKLEK

SEQ ID NO: 17891 - protein, 13 aa, Homo sapiens
LTCEEEEEKMFGR

SEQ ID NO: 17892 - protein, 13 aa, Homo sapiens
LTCEEEEEKMFGR

SEQ ID NO: 17893 - protein, 13 aa, Homo sapiens
LTCEEEEEKMFGR

SEQ ID NO: 17894 - protein, 13 aa, Homo sapiens
LTCEEEEEKMFGR

SEQ ID NO: 17895 - protein, 9 aa, Homo sapiens
AQDRLKGGR

SEQ ID NO: 17896 - protein, 7 aa, Homo sapiens
KEKAQDR

SEQ ID NO: 17897 - protein, 7 aa, Homo sapiens
KEKAQDR

SEQ ID NO: 17898 - protein, 8 aa, Homo sapiens
SVTGKIQK

SEQ ID NO: 17899 - protein, 17 aa, Homo sapiens
LTKAVATYHANTEREQK

SEQ ID NO: 17900 - protein, 7 aa, Homo sapiens
VKIKLGR

SEQ ID NO: 17901 - protein, 7 aa, Homo sapiens
VKIKLGR

SEQ ID NO: 17902 - protein, 7 aa, Homo sapiens
KEKAQDR

SEQ ID NO: 17903 - protein, 7 aa, Homo sapiens
KEKAQDR

SEQ ID NO: 17904 - protein, 7 aa, Homo sapiens
KEKAQDR

SEQ ID NO: 17905 - protein, 7 aa, Homo sapiens
KEKAQDR

SEQ ID NO: 17906 - protein, 5 aa, Homo sapiens
IKLGR

SEQ ID NO: 17907 - protein, 5 aa, Homo sapiens
IKLGR

SEQ ID NO: 17908 - protein, 7 aa, Homo sapiens
KEKAQDR

SEQ ID NO: 17909 - protein, 7 aa, Homo sapiens
VKIKLGR

SEQ ID NO: 17910 - protein, 4 aa, Homo sapiens
KSSR

SEQ ID NO: 17911 - protein, 5 aa, Homo sapiens
KIKER

SEQ ID NO: 17912 - protein, 7 aa, Homo sapiens
IRNHKYR

SEQ ID NO: 17913 - protein, 6 aa, Homo sapiens
EKAQDR

SEQ ID NO: 17914 - protein, 10 aa, Homo sapiens
VSYKGSPAAR

SEQ ID NO: 17915 - protein, 6 aa, Homo sapiens
GFKYLR

SEQ ID NO: 17916 - protein, 6 aa, Homo sapiens
GFKYLR

SEQ ID NO: 17917 - protein, 10 aa, Homo sapiens
VSYKGSPAAR

SEQ ID NO: 17918 - protein, 5 aa, Homo sapiens
LKGGR

SEQ ID NO: 17919 - protein, 10 aa, Homo sapiens
VSYKGSPAAR

SEQ ID NO: 17920 - protein, 10 aa, Homo sapiens
ASGKFELLDR

SEQ ID NO: 17921 - protein, 16 aa, Homo sapiens
KRDSDAGSSTPTTSTR

SEQ ID NO: 17922 - protein, 4 aa, Homo sapiens
KSSR

SEQ ID NO: 17923 - protein, 10 aa, Homo sapiens
VSYKGSPAAR

SEQ ID NO: 17924 - protein, 29 aa, Homo sapiens
DDGSTLMEIDGDKGKQGGPTYYIDTNALR

SEQ ID NO: 17925 - protein, 29 aa, Homo sapiens
DDGSTLMEIDGDKGKQGGPTYYIDTNALR

SEQ ID NO: 17926 - protein, 23 aa, Homo sapiens
AGYAGEDCPKVDFPTAIGMVVER

SEQ ID NO: 17927 - protein, 16 aa, Homo sapiens
GKQGGPTYYIDTNALR

SEQ ID NO: 17928 - protein, 23 aa, Homo sapiens
AGYAGEDCPKVDFPTAIGMVVER

SEQ ID NO: 17929 - protein, 16 aa, Homo sapiens
GKQGGPTYYIDTNALR

SEQ ID NO: 17930 - protein, 23 aa, Homo sapiens
AGYAGEDCPKVDFPTAIGMVVER

SEQ ID NO: 17931 - protein, 29 aa, Homo sapiens
DDGSTLMEIDGDKGKQGGPTYYIDTNALR

SEQ ID NO: 17932 - protein, 29 aa, Homo sapiens
DDGSTLMEIDGDKGKQGGPTYYIDTNALR

SEQ ID NO: 17933 - protein, 29 aa, Homo sapiens
DDGSTLMEIDGDKGKQGGPTYYIDTNALR

SEQ ID NO: 17934 - protein, 23 aa, Homo sapiens
AGYAGEDCPKVDFPTAIGMVVER

SEQ ID NO: 17935 - protein, 16 aa, Homo sapiens
GKQGGPTYYIDTNALR

SEQ ID NO: 17936 - protein, 23 aa, Homo sapiens
AGYAGEDCPKVDFPTAIGMVVER

SEQ ID NO: 17937 - protein, 16 aa, Homo sapiens
GKQGGPTYYIDTNALR

SEQ ID NO: 17938 - protein, 16 aa, Homo sapiens
GKQGGPTYYIDTNALR

SEQ ID NO: 17939 - protein, 16 aa, Homo sapiens
GKQGGPTYYIDTNALR

SEQ ID NO: 17940 - protein, 23 aa, Homo sapiens
AGYAGEDCPKVDFPTAIGMVVER

SEQ ID NO: 17941 - protein, 23 aa, Homo sapiens
AGYAGEDCPKVDFPTAIGMVVER

SEQ ID NO: 17942 - protein, 23 aa, Homo sapiens
AGYAGEDCPKVDFPTAIGMVVER

SEQ ID NO: 17943 - protein, 23 aa, Homo sapiens
AGYAGEDCPKVDFPTAIGMVVER

SEQ ID NO: 17944 - protein, 29 aa, Homo sapiens
DDGSTLMEIDGDKGKQGGPTYYIDTNALR

SEQ ID NO: 17945 - protein, 29 aa, Homo sapiens
DDGSTLMEIDGDKGKQGGPTYYIDTNALR

SEQ ID NO: 17946 - protein, 23 aa, Homo sapiens
AGYAGEDCPKVDFPTAIGMVVER

SEQ ID NO: 17947 - protein, 29 aa, Homo sapiens
DDGSTLMEIDGDKGKQGGPTYYIDTNALR

SEQ ID NO: 17948 - protein, 23 aa, Homo sapiens
AGYAGEDCPKVDFPTAIGMVVER

SEQ ID NO: 17949 - protein, 23 aa, Homo sapiens
AGYAGEDCPKVDFPTAIGMVVER

SEQ ID NO: 17950 - protein, 23 aa, Homo sapiens
AGYAGEDCPKVDFPTAIGMVVER

SEQ ID NO: 17951 - protein, 29 aa, Homo sapiens
DDGSTLMEIDGDKGKQGGPTYYIDTNALR

SEQ ID NO: 17952 - protein, 29 aa, Homo sapiens
DDGSTLMEIDGDKGKQGGPTYYIDTNALR

SEQ ID NO: 17953 - protein, 23 aa, Homo sapiens
AGYAGEDCPKVDFPTAIGMVVER

SEQ ID NO: 17954 - protein, 29 aa, Homo sapiens
DDGSTLMEIDGDKGKQGGPTYYIDTNALR

SEQ ID NO: 17955 - protein, 29 aa, Homo sapiens
DDGSTLMEIDGDKGKQGGPTYYIDTNALR

SEQ ID NO: 17956 - protein, 13 aa, Homo sapiens
EAVREGSPANWKR

SEQ ID NO: 17957 - protein, 9 aa, Homo sapiens
KEKLPQVTR

SEQ ID NO: 17958 - protein, 9 aa, Homo sapiens
EGSPANWKR

SEQ ID NO: 17959 - protein, 9 aa, Homo sapiens
KEKLPQVTR

SEQ ID NO: 17960 - protein, 9 aa, Homo sapiens
KEKLPQVTR

SEQ ID NO: 17961 - protein, 9 aa, Homo sapiens
EGSPANWKR

SEQ ID NO: 17962 - protein, 13 aa, Homo sapiens
EAVREGSPANWKR

SEQ ID NO: 17963 - protein, 9 aa, Homo sapiens
EGSPANWKR

SEQ ID NO: 17964 - protein, 9 aa, Homo sapiens
KEKLPQVTR

SEQ ID NO: 17965 - protein, 9 aa, Homo sapiens
KEKLPQVTR

SEQ ID NO: 17966 - protein, 13 aa, Homo sapiens
EAVREGSPANWKR

SEQ ID NO: 17967 - protein, 9 aa, Homo sapiens
KEKLPQVTR

SEQ ID NO: 17968 - protein, 9 aa, Homo sapiens
KEKLPQVTR

SEQ ID NO: 17969 - protein, 9 aa, Homo sapiens
KEKLPQVTR

SEQ ID NO: 17970 - protein, 9 aa, Homo sapiens
EGSPANWKR

SEQ ID NO: 17971 - protein, 13 aa, Homo sapiens
EAVREGSPANWKR

SEQ ID NO: 17972 - protein, 13 aa, Homo sapiens
EAVREGSPANWKR

SEQ ID NO: 17973 - protein, 9 aa, Homo sapiens
EGSPANWKR

SEQ ID NO: 17974 - protein, 13 aa, Homo sapiens
EAVREGSPANWKR

SEQ ID NO: 17975 - protein, 9 aa, Homo sapiens
KEKLPQVTR

SEQ ID NO: 17976 - protein, 13 aa, Homo sapiens
EAVREGSPANWKR

SEQ ID NO: 17977 - protein, 9 aa, Homo sapiens
KEKLPQVTR

SEQ ID NO: 17978 - protein, 9 aa, Homo sapiens
KEKLPQVTR

SEQ ID NO: 17979 - protein, 9 aa, Homo sapiens
KEKLPQVTR

SEQ ID NO: 17980 - protein, 9 aa, Homo sapiens
KEKLPQVTR

SEQ ID NO: 17981 - protein, 9 aa, Homo sapiens
KEKLPQVTR

SEQ ID NO: 17982 - protein, 8 aa, Homo sapiens
EKLPQVTR

SEQ ID NO: 17983 - protein, 9 aa, Homo sapiens
KEKLPQVTR

SEQ ID NO: 17984 - protein, 20 aa, Homo sapiens
EKLTELMFEHYNIPAFFLCK

SEQ ID NO: 17985 - protein, 20 aa, Homo sapiens
EKLTELMFEHYNIPAFFLCK

SEQ ID NO: 17986 - protein, 20 aa, Homo sapiens
EKLTELMFEHYNIPAFFLCK

SEQ ID NO: 17987 - protein, 13 aa, Homo sapiens
QEYEEGGKQCVER

SEQ ID NO: 17988 - protein, 20 aa, Homo sapiens
EKLTELMFEHYNIPAFFLCK

SEQ ID NO: 17989 - protein, 23 aa, Homo sapiens
ELFQEMNIELVPPYMIASKEAVR

SEQ ID NO: 17990 - protein, 9 aa, Homo sapiens
KEKLPQVTR

SEQ ID NO: 17991 - protein, 9 aa, Homo sapiens
KEKLPQVTR

SEQ ID NO: 17992 - protein, 9 aa, Homo sapiens
KEKLPQVTR

SEQ ID NO: 17993 - protein, 9 aa, Homo sapiens
KEKLPQVTR

SEQ ID NO: 17994 - protein, 23 aa, Homo sapiens
ELFQEMNIELVPPYMIASKEAVR

SEQ ID NO: 17995 - protein, 9 aa, Homo sapiens
KEKLPQVTR

SEQ ID NO: 17996 - protein, 9 aa, Homo sapiens
KEKLPQVTR

SEQ ID NO: 17997 - protein, 11 aa, Homo sapiens
ELSQKTPPSMR

SEQ ID NO: 17998 - protein, 11 aa, Homo sapiens
ELSQKTPPSMR

SEQ ID NO: 17999 - protein, 15 aa, Homo sapiens
YKAVSISTEPPTYLR

SEQ ID NO: 18000 - protein, 15 aa, Homo sapiens
TTWAIKHAASNPSKK

SEQ ID NO: 18001 - protein, 9 aa, Homo sapiens
HAASNPSKK

SEQ ID NO: 18002 - protein, 9 aa, Homo sapiens
HAASNPSKK

SEQ ID NO: 18003 - protein, 9 aa, Homo sapiens
HAASNPSKK

SEQ ID NO: 18004 - protein, 17 aa, Homo sapiens
KRNYILDQTNVYGSAQR

SEQ ID NO: 18005 - protein, 21 aa, Homo sapiens
INEEISVKHLPSTEPDPHVVR

SEQ ID NO: 18006 - protein, 10 aa, Homo sapiens
NGKWMGIAFR

SEQ ID NO: 18007 - protein, 10 aa, Homo sapiens
NGKWMGIAFR

SEQ ID NO: 18008 - protein, 6 aa, Homo sapiens
KSTNSR

SEQ ID NO: 18009 - protein, 21 aa, Homo sapiens
INEEISVKHLPSTEPDPHVVR

SEQ ID NO: 18010 - protein, 6 aa, Homo sapiens
KSTNSR

SEQ ID NO: 18011 - protein, 21 aa, Homo sapiens
INEEISVKHLPSTEPDPHVVR

SEQ ID NO: 18012 - protein, 20 aa, Homo sapiens
QNQFYDTQVIKQENESGYER

SEQ ID NO: 18013 - protein, 21 aa, Homo sapiens
QNQFYDTQVIKQENESGYERR

SEQ ID NO: 18014 - protein, 9 aa, Homo sapiens
KAGPPPEKR

SEQ ID NO: 18015 - protein, 21 aa, Homo sapiens
HAASNPSKKYNILGTNAIMDK

SEQ ID NO: 18016 - protein, 14 aa, Homo sapiens
TTWAIKHAASNPSK

SEQ ID NO: 18017 - protein, 9 aa, Homo sapiens
GLKAELAER

SEQ ID NO: 18018 - protein, 9 aa, Homo sapiens
GLKAELAER

SEQ ID NO: 18019 - protein, 9 aa, Homo sapiens
GLKAELAER

SEQ ID NO: 18020 - protein, 6 aa, Homo sapiens
KSTNSR

SEQ ID NO: 18021 - protein, 6 aa, Homo sapiens
KSTNSR

SEQ ID NO: 18022 - protein, 8 aa, Homo sapiens
GTVGPKSK

SEQ ID NO: 18023 - protein, 8 aa, Homo sapiens
KRPYEENR

SEQ ID NO: 18024 - protein, 8 aa, Homo sapiens
KRPYEENR

SEQ ID NO: 18025 - protein, 8 aa, Homo sapiens
KRPYEENR

SEQ ID NO: 18026 - protein, 21 aa, Homo sapiens
TPTTQETDGFQVKRPGDLSVR

SEQ ID NO: 18027 - protein, 21 aa, Homo sapiens
TPTTQETDGFQVKRPGDLSVR

SEQ ID NO: 18028 - protein, 21 aa, Homo sapiens
TPTTQETDGFQVKRPGDLSVR

SEQ ID NO: 18029 - protein, 9 aa, Homo sapiens
ETERIEKER

SEQ ID NO: 18030 - protein, 8 aa, Homo sapiens
LIDQKKDR

SEQ ID NO: 18031 - protein, 16 aa, Homo sapiens
LMAEDEEGYRKLIDQK

SEQ ID NO: 18032 - protein, 8 aa, Homo sapiens
KVMATIEK

SEQ ID NO: 18033 - protein, 6 aa, Homo sapiens
AKDDIK

SEQ ID NO: 18034 - protein, 8 aa, Homo sapiens
KVMATIEK

SEQ ID NO: 18035 - protein, 7 aa, Homo sapiens
AKDDIKK

SEQ ID NO: 18036 - protein, 12 aa, Homo sapiens
IVKKNNLFVVDR

SEQ ID NO: 18037 - protein, 12 aa, Homo sapiens
IVKKNNLFVVDR

SEQ ID NO: 18038 - protein, 12 aa, Homo sapiens
IVKKNNLFVVDR

SEQ ID NO: 18039 - protein, 9 aa, Homo sapiens
KNNLFVVDR

SEQ ID NO: 18040 - protein, 9 aa, Homo sapiens
KNNLFVVDR

SEQ ID NO: 18041 - protein, 10 aa, Homo sapiens
NIKLLEDEPR

SEQ ID NO: 18042 - protein, 10 aa, Homo sapiens
NIKLLEDEPR

SEQ ID NO: 18043 - protein, 10 aa, Homo sapiens
NIKLLEDEPR

SEQ ID NO: 18044 - protein, 14 aa, Homo sapiens
MPYEPNKDPFGGMR

SEQ ID NO: 18045 - protein, 14 aa, Homo sapiens
MPYEPNKDPFGGMR

SEQ ID NO: 18046 - protein, 14 aa, Homo sapiens
MPYEPNKDPFGGMR

SEQ ID NO: 18047 - protein, 14 aa, Homo sapiens
MPYEPNKDPFGGMR

SEQ ID NO: 18048 - protein, 14 aa, Homo sapiens
MPYEPNKDPFGGMR

SEQ ID NO: 18049 - protein, 14 aa, Homo sapiens
MPYEPNKDPFGGMR

SEQ ID NO: 18050 - protein, 14 aa, Homo sapiens
MPYEPNKDPFGGMR

SEQ ID NO: 18051 - protein, 21 aa, Homo sapiens
MPTTQETDGFQVKRPGDLNVK

SEQ ID NO: 18052 - protein, 21 aa, Homo sapiens
MPTTQETDGFQVKRPGDLNVK

SEQ ID NO: 18053 - protein, 21 aa, Homo sapiens
MPTTQETDGFQVKRPGDLNVK

SEQ ID NO: 18054 - protein, 21 aa, Homo sapiens
MPTTQETDGFQVKRPGDLNVK

SEQ ID NO: 18055 - protein, 14 aa, Homo sapiens
MPTTQETDGFQVKR

SEQ ID NO: 18056 - protein, 14 aa, Homo sapiens
MPTTQETDGFQVKR

SEQ ID NO: 18057 - protein, 14 aa, Homo sapiens
MPTTQETDGFQVKR

SEQ ID NO: 18058 - protein, 14 aa, Homo sapiens
MPTTQETDGFQVKR

SEQ ID NO: 18059 - protein, 14 aa, Homo sapiens
MPTTQETDGFQVKR

SEQ ID NO: 18060 - protein, 14 aa, Homo sapiens
MPTTQETDGFQVKR

SEQ ID NO: 18061 - protein, 21 aa, Homo sapiens
MPTTQETDGFQVKRPGDLNVK

SEQ ID NO: 18062 - protein, 21 aa, Homo sapiens
MPTTQETDGFQVKRPGDLNVK

SEQ ID NO: 18063 - protein, 21 aa, Homo sapiens
MPTTQETDGFQVKRPGDLNVK

SEQ ID NO: 18064 - protein, 21 aa, Homo sapiens
MPTTQETDGFQVKRPGDLNVK

SEQ ID NO: 18065 - protein, 21 aa, Homo sapiens
MPTTQETDGFQVKRPGDLNVK

SEQ ID NO: 18066 - protein, 21 aa, Homo sapiens
MPTTQETDGFQVKRPGDLNVK

SEQ ID NO: 18067 - protein, 38 aa, Homo sapiens; identical to SEQ ID NO: 8179

SEQ ID NO: 18068 - protein, 21 aa, Homo sapiens
MPTTQETDGFQVKRPGDLNVK

SEQ ID NO: 18069 - protein, 21 aa, Homo sapiens
MPTTQETDGFQVKRPGDLNVK

SEQ ID NO: 18070 - protein, 26 aa, Homo sapiens
LAGLLQHPDPIVINHVISVDPNDQKK

SEQ ID NO: 18071 - protein, 26 aa, Homo sapiens
LAGLLQHPDPIVINHVISVDPNDQKK

SEQ ID NO: 18072 - protein, 6 aa, Homo sapiens
PLTQKR

SEQ ID NO: 18073 - protein, 6 aa, Homo sapiens
PLTQKR

SEQ ID NO: 18074 - protein, 7 aa, Homo sapiens
KPLTQKR

SEQ ID NO: 18075 - protein, 11 aa, Homo sapiens
VEGKLLDDPSK

SEQ ID NO: 18076 - protein, 11 aa, Homo sapiens
VEGKLLDDPSK

SEQ ID NO: 18077 - protein, 14 aa, Homo sapiens
FLESTDSFNNELKR

SEQ ID NO: 18078 - protein, 12 aa, Homo sapiens
LCGLKVEVDMEK

SEQ ID NO: 18079 - protein, 14 aa, Homo sapiens
FLESTDSFNNELKR

SEQ ID NO: 18080 - protein, 14 aa, Homo sapiens
FLESTDSFNNELKR

SEQ ID NO: 18081 - protein, 25 aa, Homo sapiens
LCGLKVEVDMEKIAAEIAQAEEQAR

SEQ ID NO: 18082 - protein, 14 aa, Homo sapiens
FLESTDSFNNELKR

SEQ ID NO: 18083 - protein, 14 aa, Homo sapiens
FLESTDSFNNELKR

SEQ ID NO: 18084 - protein, 14 aa, Homo sapiens
FLESTDSFNNELKR

SEQ ID NO: 18085 - protein, 25 aa, Homo sapiens
LCGLKVEVDMEKIAAEIAQAEEQAR

SEQ ID NO: 18086 - protein, 14 aa, Homo sapiens
FLESTDSFNNELKR

SEQ ID NO: 18087 - protein, 14 aa, Homo sapiens
FLESTDSFNNELKR

SEQ ID NO: 18088 - protein, 14 aa, Homo sapiens
FLESTDSFNNELKR

SEQ ID NO: 18089 - protein, 14 aa, Homo sapiens
FLESTDSFNNELKR

SEQ ID NO: 18090 - protein, 12 aa, Homo sapiens
LCGLKVEVDMEK

SEQ ID NO: 18091 - protein, 19 aa, Homo sapiens
VWDQVKASNPDLKLWEIGK

SEQ ID NO: 18092 - protein, 16 aa, Homo sapiens
KTGQPEELVSCSDCGR

SEQ ID NO: 18093 - protein, 19 aa, Homo sapiens
INKKTGQPEELVSCSDCGR

SEQ ID NO: 18094 - protein, 6 aa, Homo sapiens
GKGKSK

SEQ ID NO: 18095 - protein, 16 aa, Homo sapiens
KTGQPEELVSCSDCGR

SEQ ID NO: 18096 - protein, 16 aa, Homo sapiens
KTGQPEELVSCSDCGR

SEQ ID NO: 18097 - protein, 16 aa, Homo sapiens
KTGQPEELVSCSDCGR

SEQ ID NO: 18098 - protein, 12 aa, Homo sapiens
EKASIYQNQNSS

SEQ ID NO: 18099 - protein, 8 aa, Homo sapiens
SEEQKSKK

SEQ ID NO: 18100 - protein, 8 aa, Homo sapiens
SEEQKSKK

SEQ ID NO: 18101 - protein, 7 aa, Homo sapiens
SEEQKSK

SEQ ID NO: 18102 - protein, 21 aa, Homo sapiens
KGPDGLALPNNYCDFCLGDSK

SEQ ID NO: 18103 - protein, 7 aa, Homo sapiens
SEEQKSK

SEQ ID NO: 18104 - protein, 21 aa, Homo sapiens
KGPDGLALPNNYCDFCLGDSK

SEQ ID NO: 18105 - protein, 21 aa, Homo sapiens
KGPDGLALPNNYCDFCLGDSK

SEQ ID NO: 18106 - protein, 21 aa, Homo sapiens
KGPDGLALPNNYCDFCLGDSK

SEQ ID NO: 18107 - protein, 8 aa, Homo sapiens
GKGVGSAR

SEQ ID NO: 18108 - protein, 7 aa, Homo sapiens
TDPLEKR

SEQ ID NO: 18109 - protein, 7 aa, Homo sapiens
TDPLEKR

SEQ ID NO: 18110 - protein, 17 aa, Homo sapiens
KEGLISQDGSSLEALLR

SEQ ID NO: 18111 - protein, 15 aa, Homo sapiens
LSFPSIKPDTDQTLK

SEQ ID NO: 18112 - protein, 8 aa, Homo sapiens
GKGVGSAR

SEQ ID NO: 18113 - protein, 5 aa, Homo sapiens
RGKGK

SEQ ID NO: 18114 - protein, 5 aa, Homo sapiens
RGKGK

SEQ ID NO: 18115 - protein, 8 aa, Homo sapiens
TLFQLKQR

SEQ ID NO: 18116 - protein, 8 aa, Homo sapiens
TLFQLKQR

SEQ ID NO: 18117 - protein, 8 aa, Homo sapiens
DAGSYSKK

SEQ ID NO: 18118 - protein, 23 aa, Homo sapiens
VAPEEHPVLLTEAPLNPKANREK

SEQ ID NO: 18119 - protein, 21 aa, Homo sapiens
VAPEEHPVLLTEAPLNPKANR

SEQ ID NO: 18120 - protein, 9 aa, Homo sapiens
IKIIAPPER

SEQ ID NO: 18121 - protein, 9 aa, Homo sapiens
IKIIAPPER

SEQ ID NO: 18122 - protein, 10 aa, Homo sapiens
IKIIAPPERK

SEQ ID NO: 18123 - protein, 9 aa, Homo sapiens
IKIIAPPER

SEQ ID NO: 18124 - protein, 22 aa, Homo sapiens
KDLYANTVLSGGTTMYPGIADR

SEQ ID NO: 18125 - protein, 10 aa, Homo sapiens
IKIIAPPERK

SEQ ID NO: 18126 - protein, 22 aa, Homo sapiens
KDLYANTVLSGGTTMYPGIADR

SEQ ID NO: 18127 - protein, 9 aa, Homo sapiens
IKIIAPPER

SEQ ID NO: 18128 - protein, 9 aa, Homo sapiens
IKIIAPPER

SEQ ID NO: 18129 - protein, 22 aa, Homo sapiens
KDLYANTVLSGGTTMYPGIADR

SEQ ID NO: 18130 - protein, 28 aa, Homo sapiens
CDVDIRKDLYANTVLSGGTTMYPGIADR

SEQ ID NO: 18131 - protein, 10 aa, Homo sapiens
IKIIAPPERK

SEQ ID NO: 18132 - protein, 9 aa, Homo sapiens
IKIIAPPER

SEQ ID NO: 18133 - protein, 22 aa, Homo sapiens
KDLYANTVLSGGTTMYPGIADR

SEQ ID NO: 18134 - protein, 22 aa, Homo sapiens
KDLYANTVLSGGTTMYPGIADR

SEQ ID NO: 18135 - protein, 22 aa, Homo sapiens
KDLYANTVLSGGTTMYPGIADR

SEQ ID NO: 18136 - protein, 9 aa, Homo sapiens
IKIIAPPER

SEQ ID NO: 18137 - protein, 9 aa, Homo sapiens
IKIIAPPER

SEQ ID NO: 18138 - protein, 28 aa, Homo sapiens
CDVDIRKDLYANTVLSGGTTMYPGIADR

SEQ ID NO: 18139 - protein, 9 aa, Homo sapiens
IKIIAPPER

SEQ ID NO: 18140 - protein, 9 aa, Homo sapiens
IKIIAPPER

SEQ ID NO: 18141 - protein, 9 aa, Homo sapiens
IKIIAPPER

SEQ ID NO: 18142 - protein, 16 aa, Homo sapiens
MQKEITALAPSTMKIK

SEQ ID NO: 18143 - protein, 16 aa, Homo sapiens
MQKEITALAPSTMKIK

SEQ ID NO: 18144 - protein, 16 aa, Homo sapiens
MQKEITALAPSTMKIK

SEQ ID NO: 18145 - protein, 16 aa, Homo sapiens
MQKEITALAPSTMKIK

SEQ ID NO: 18146 - protein, 13 aa, Homo sapiens
EITALAPSTMKIK

SEQ ID NO: 18147 - protein, 13 aa, Homo sapiens
EITALAPSTMKIK

SEQ ID NO: 18148 - protein, 16 aa, Homo sapiens
MQKEITALAPSTMKIK

SEQ ID NO: 18149 - protein, 22 aa, Homo sapiens
KDLYANTVLSGGTTMYPGIADR

SEQ ID NO: 18150 - protein, 28 aa, Homo sapiens
CDVDIRKDLYANTVLSGGTTMYPGIADR

SEQ ID NO: 18151 - protein, 28 aa, Homo sapiens
CDVDIRKDLYANTVLSGGTTMYPGIADR

SEQ ID NO: 18152 - protein, 16 aa, Homo sapiens
MQKEITALAPSTMKIK

SEQ ID NO: 18153 - protein, 22 aa, Homo sapiens
KDLYANTVLSGGTTMYPGIADR

SEQ ID NO: 18154 - protein, 15 aa, Drosophila melanogaster
KPLGKDGGLELGDKS

SEQ ID NO: 18155 - protein, 17 aa, Drosophila melanogaster
RAIDSMEEKGLQEDPRY

SEQ ID NO: 18156 - protein, 17 aa, Drosophila melanogaster
RAIDSMEEKGLQEDPRY

SEQ ID NO: 18157 - protein, 17 aa, Drosophila melanogaster
RAIDSMEEKGLQEDPRY

SEQ ID NO: 18158 - protein, 17 aa, Drosophila melanogaster
RAIDSMEEKGLQEDPRY

SEQ ID NO: 18159 - protein, 17 aa, Drosophila melanogaster
RAIDSMEEKGLQEDPRY

SEQ ID NO: 18160 - protein, 17 aa, Drosophila melanogaster
RAIDSMEEKGLQEDPRY

SEQ ID NO: 18161 - protein, 17 aa, Drosophila melanogaster
RAIDSMEEKGLQEDPRY

SEQ ID NO: 18162 - protein, 17 aa, Drosophila melanogaster
RAIDSMEEKGLQEDPRY

SEQ ID NO: 18163 - protein, 17 aa, Drosophila melanogaster
RAIDSMEEKGLQEDPRY

SEQ ID NO: 18164 - protein, 17 aa, Drosophila melanogaster
RAIDSMEEKGLQEDPRY

SEQ ID NO: 18165 - protein, 17 aa, Drosophila melanogaster
RAIDSMEEKGLQEDPRY

SEQ ID NO: 18166 - protein, 17 aa, Drosophila melanogaster
RAIDSMEEKGLQEDPRY

SEQ ID NO: 18167 - protein, 17 aa, Drosophila melanogaster
RAIDSMEEKGLQEDPRY

SEQ ID NO: 18168 - protein, 17 aa, Drosophila melanogaster
RAIDSMEEKGLQEDPRY

SEQ ID NO: 18169 - protein, 18 aa, Drosophila melanogaster
KHLEFLAAVLQHGKDLRE

SEQ ID NO: 18170 - protein, 18 aa, Drosophila melanogaster
KHLEFLAAVLQHGKDLRE

SEQ ID NO: 18171 - protein, 30 aa, Drosophila melanogaster
RTFPMCFDDTDPTASLENAAQKECLVPIRL

SEQ ID NO: 18172 - protein, 13 aa, Drosophila melanogaster
RAMPEFFNSKNKS

SEQ ID NO: 18173 - protein, 11 aa, Drosophila melanogaster
RLDIQEALKRP

SEQ ID NO: 18174 - protein, 11 aa, Drosophila melanogaster
RLDIQEALKRP

SEQ ID NO: 18175 - protein, 11 aa, Drosophila melanogaster
RLDIQEALKRP

SEQ ID NO: 18176 - protein, 19 aa, Drosophila melanogaster
RGTGAGGGGVGSGGGSKRS

SEQ ID NO: 18177 - protein, 19 aa, Drosophila melanogaster
RGTGAGGGGVGSGGGSKRS

SEQ ID NO: 18178 - protein, 19 aa, Drosophila melanogaster
RGTGAGGGGVGSGGGSKRS

SEQ ID NO: 18179 - protein, 19 aa, Drosophila melanogaster
RGTGAGGGGVGSGGGSKRS

SEQ ID NO: 18180 - protein, 12 aa, Drosophila melanogaster
RLEKLCAVLTRH

SEQ ID NO: 18181 - protein, 17 aa, Drosophila melanogaster
KIHETVDTINQMKTNRE

SEQ ID NO: 18182 - protein, 17 aa, Drosophila melanogaster
KIHETVDTINQMKTNRE

SEQ ID NO: 18183 - protein, 17 aa, Drosophila melanogaster
KIHETVDTINQMKTNRE

SEQ ID NO: 18184 - protein, 17 aa, Drosophila melanogaster
KIHETVDTINQMKTNRE

SEQ ID NO: 18185 - protein, 16 aa, Drosophila melanogaster
RQQFHLEQLKAAEFRA

SEQ ID NO: 18186 - protein, 16 aa, Drosophila melanogaster
RQQFHLEQLKAAEFRA

SEQ ID NO: 18187 - protein, 16 aa, Drosophila melanogaster
RQQFHLEQLKAAEFRA

SEQ ID NO: 18188 - protein, 16 aa, Drosophila melanogaster
RQQFHLEQLKAAEFRA

SEQ ID NO: 18189 - protein, 16 aa, Drosophila melanogaster
RQQFHLEQLKAAEFRA

SEQ ID NO: 18190 - protein, 16 aa, Drosophila melanogaster
RQQFHLEQLKAAEFRA

SEQ ID NO: 18191 - protein, 16 aa, Drosophila melanogaster
RQQFHLEQLKAAEFRA

SEQ ID NO: 18192 - protein, 16 aa, Drosophila melanogaster
RQQFHLEQLKAAEFRA

SEQ ID NO: 18193 - protein, 16 aa, Drosophila melanogaster
RQQFHLEQLKAAEFRA

SEQ ID NO: 18194 - protein, 16 aa, Drosophila melanogaster
RQQFHLEQLKAAEFRA

SEQ ID NO: 18195 - protein, 16 aa, Drosophila melanogaster
RQQFHLEQLKAAEFRA

SEQ ID NO: 18196 - protein, 16 aa, Drosophila melanogaster
RQQFHLEQLKAAEFRA

SEQ ID NO: 18197 - protein, 16 aa, Drosophila melanogaster
RQQFHLEQLKAAEFRA

SEQ ID NO: 18198 - protein, 16 aa, Drosophila melanogaster
RQQFHLEQLKAAEFRA

SEQ ID NO: 18199 - protein, 16 aa, Drosophila melanogaster
RQQFHLEQLKAAEFRA

SEQ ID NO: 18200 - protein, 16 aa, Drosophila melanogaster
RQQFHLEQLKAAEFRA

SEQ ID NO: 18201 - protein, 16 aa, Drosophila melanogaster
RQQFHLEQLKAAEFRA

SEQ ID NO: 18202 - protein, 16 aa, Drosophila melanogaster
RQQFHLEQLKAAEFRA

SEQ ID NO: 18203 - protein, 16 aa, Drosophila melanogaster
RQQFHLEQLKAAEFRA

SEQ ID NO: 18204 - protein, 16 aa, Drosophila melanogaster
RQQFHLEQLKAAEFRA

SEQ ID NO: 18205 - protein, 42 aa, Drosophila melanogaster
RLNPLLHPPDPIVINHFIESGAENKQTACYDIDVEVDDTLKN

SEQ ID NO: 18206 - protein, 42 aa, Drosophila melanogaster; identical to SEQ ID NO: 18205

SEQ ID NO: 18207 - protein, 42 aa, Drosophila melanogaster; identical to SEQ ID NO: 18205

SEQ ID NO: 18208 - protein, 12 aa, Drosophila melanogaster
KAKHLAALEERK

SEQ ID NO: 18209 - protein, 12 aa, Drosophila melanogaster
KAKHLAALEERK

SEQ ID NO: 18210 - protein, 12 aa, Drosophila melanogaster
KAKHLAALEERK

SEQ ID NO: 18211 - protein, 12 aa, Drosophila melanogaster
KAKHLAALEERK

SEQ ID NO: 18212 - protein, 13 aa, Drosophila melanogaster
KAKHLAALEERKI

SEQ ID NO: 18213 - protein, 9 aa, Drosophila melanogaster
KILPQKVRD

SEQ ID NO: 18214 - protein, 16 aa, Drosophila melanogaster
RQQFHLEQLKAAEFRA

SEQ ID NO: 18215 - protein, 16 aa, Drosophila melanogaster
RQQFHLEQLKAAEFRA

SEQ ID NO: 18216 - protein, 16 aa, Drosophila melanogaster
RQQFHLEQLKAAEFRA

SEQ ID NO: 18217 - protein, 16 aa, Drosophila melanogaster
RQQFHLEQLKAAEFRA

SEQ ID NO: 18218 - protein, 16 aa, Drosophila melanogaster
RQQFHLEQLKAAEFRA

SEQ ID NO: 18219 - protein, 11 aa, Drosophila melanogaster
RMKFAEIPQRL

SEQ ID NO: 18220 - protein, 11 aa, Drosophila melanogaster
KLAEKILPQKV

SEQ ID NO: 18221 - protein, 9 aa, Drosophila melanogaster
KKLEIKLRH

SEQ ID NO: 18222 - protein, 16 aa, Drosophila melanogaster
RQQFHLEQLKAAEFRA

SEQ ID NO: 18223 - protein, 20 aa, Drosophila melanogaster
RTHTTQETDGFQVKRPGDRN

SEQ ID NO: 18224 - protein, 20 aa, Drosophila melanogaster
RTHTTQETDGFQVKRPGDRN

SEQ ID NO: 18225 - protein, 20 aa, Drosophila melanogaster
RTHTTQETDGFQVKRPGDRN

SEQ ID NO: 18226 - protein, 16 aa, Drosophila melanogaster
RQQFHLEQLKAAEFRA

SEQ ID NO: 18227 - protein, 9 aa, Drosophila melanogaster
RKFSSFFKS

SEQ ID NO: 18228 - protein, 19 aa, Drosophila melanogaster
REYINCDKYLEQIFSCQRM

SEQ ID NO: 18229 - protein, 16 aa, Drosophila melanogaster
RQQFHLEQLKAAEFRA

SEQ ID NO: 18230 - protein, 11 aa, Drosophila melanogaster
RYFFTKVNQKR

SEQ ID NO: 18231 - protein, 11 aa, Drosophila melanogaster
RYFFTKVNQKR

SEQ ID NO: 18232 - protein, 19 aa, Drosophila melanogaster
RIPYIYIRPEIEKGFEGKL

SEQ ID NO: 18233 - protein, 19 aa, Drosophila melanogaster
RIPYIYIRPEIEKGFEGKL

SEQ ID NO: 18234 - protein, 19 aa, Drosophila melanogaster
RIPYIYIRPEIEKGFEGKL

SEQ ID NO: 18235 - protein, 16 aa, Drosophila melanogaster
RQQFHLEQLKAAEFRA

SEQ ID NO: 18236 - protein, 19 aa, Drosophila melanogaster
RGTGAGGGGVGSGGGSKRS

SEQ ID NO: 18237 - protein, 19 aa, Drosophila melanogaster
RGTGAGGGGVGSGGGSKRS

SEQ ID NO: 18238 - protein, 19 aa, Drosophila melanogaster
RGTGAGGGGVGSGGGSKRS

SEQ ID NO: 18239 - protein, 19 aa, Drosophila melanogaster
RGTGAGGGGVGSGGGSKRS

SEQ ID NO: 18240 - protein, 15 aa, Drosophila melanogaster
KKSRNDDDDEDLTRD

SEQ ID NO: 18241 - protein, 15 aa, Drosophila melanogaster
KKSRNDDDDEDLTRD

SEQ ID NO: 18242 - protein, 20 aa, Drosophila melanogaster
KANAALQSTASPAPGGKSRG

SEQ ID NO: 18243 - protein, 19 aa, Drosophila melanogaster
RGTGAGGGGVGSGGGSKRS

SEQ ID NO: 18244 - protein, 19 aa, Drosophila melanogaster
RGTGAGGGGVGSGGGSKRS

SEQ ID NO: 18245 - protein, 19 aa, Drosophila melanogaster
RGTGAGGGGVGSGGGSKRS

SEQ ID NO: 18246 - protein, 19 aa, Drosophila melanogaster
RGTGAGGGGVGSGGGSKRS

SEQ ID NO: 18247 - protein, 19 aa, Drosophila melanogaster
RIPYIYIRPEIEKGFEGKL

SEQ ID NO: 18248 - protein, 16 aa, Drosophila melanogaster
RQQFHLEQLKAAEFRA

SEQ ID NO: 18249 - protein, 16 aa, Drosophila melanogaster
RQQFHLEQLKAAEFRA

SEQ ID NO: 18250 - protein, 16 aa, Drosophila melanogaster
RQQFHLEQLKAAEFRA

SEQ ID NO: 18251 - protein, 16 aa, Drosophila melanogaster
RQQFHLEQLKAAEFRA

SEQ ID NO: 18252 - protein, 16 aa, Drosophila melanogaster
RQQFHLEQLKAAEFRA

SEQ ID NO: 18253 - protein, 16 aa, Drosophila melanogaster
RQQFHLEQLKAAEFRA

SEQ ID NO: 18254 - protein, 16 aa, Drosophila melanogaster
RQQFHLEQLKAAEFRA

SEQ ID NO: 18255 - protein, 16 aa, Drosophila melanogaster
RQQFHLEQLKAAEFRA

SEQ ID NO: 18256 - protein, 16 aa, Drosophila melanogaster
RQQFHLEQLKAAEFRA

SEQ ID NO: 18257 - protein, 16 aa, Drosophila melanogaster
RQQFHLEQLKAAEFRA

SEQ ID NO: 18258 - protein, 16 aa, Drosophila melanogaster
RQQFHLEQLKAAEFRA

SEQ ID NO: 18259 - protein, 16 aa, Drosophila melanogaster
RQQFHLEQLKAAEFRA

SEQ ID NO: 18260 - protein, 16 aa, Drosophila melanogaster
RQQFHLEQLKAAEFRA

SEQ ID NO: 18261 - protein, 16 aa, Drosophila melanogaster
RQQFHLEQLKAAEFRA

SEQ ID NO: 18262 - protein, 16 aa, Drosophila melanogaster
RQQFHLEQLKAAEFRA

SEQ ID NO: 18263 - protein, 14 aa, Drosophila melanogaster
KLDQYAKKPAAMRN

SEQ ID NO: 18264 - protein, 14 aa, Drosophila melanogaster
KLDQYAKKPAAMRN

SEQ ID NO: 18265 - protein, 10 aa, Drosophila melanogaster
RKLDATIMRK

SEQ ID NO: 18266 - protein, 14 aa, Drosophila melanogaster
KTLLDLDKKPLGKD

SEQ ID NO: 18267 - protein, 10 aa, Drosophila melanogaster
RKLDATIMRK

SEQ ID NO: 18268 - protein, 18 aa, Drosophila melanogaster
REFFLSFAKDPQMFIHRW

SEQ ID NO: 18269 - protein, 18 aa, Drosophila melanogaster
REFFLSFAKDPQMFIHRW

SEQ ID NO: 18270 - protein, 18 aa, Drosophila melanogaster
REFFLSFAKDPQMFIHRW

SEQ ID NO: 18271 - protein, 18 aa, Drosophila melanogaster
REFFLSFAKDPQMFIHRW

SEQ ID NO: 18272 - protein, 18 aa, Drosophila melanogaster
REFFLSFAKDPQMFIHRW

SEQ ID NO: 18273 - protein, 18 aa, Drosophila melanogaster
REFFLSFAKDPQMFIHRW

SEQ ID NO: 18274 - protein, 18 aa, Drosophila melanogaster
REFFLSFAKDPQMFIHRW

SEQ ID NO: 18275 - protein, 18 aa, Drosophila melanogaster
REFFLSFAKDPQMFIHRW

SEQ ID NO: 18276 - protein, 18 aa, Drosophila melanogaster
REFFLSFAKDPQMFIHRW

SEQ ID NO: 18277 - protein, 18 aa, Drosophila melanogaster
REFFLSFAKDPQMFIHRW

SEQ ID NO: 18278 - protein, 18 aa, Drosophila melanogaster
REFFLSFAKDPQMFIHRW

SEQ ID NO: 18279 - protein, 18 aa, Drosophila melanogaster
REFFLSFAKDPQMFIHRW

SEQ ID NO: 18280 - protein, 18 aa, Drosophila melanogaster
REFFLSFAKDPQMFIHRW

SEQ ID NO: 18281 - protein, 18 aa, Drosophila melanogaster
REFFLSFAKDPQMFIHRW

SEQ ID NO: 18282 - protein, 18 aa, Drosophila melanogaster
REFFLSFAKDPQMFIHRW

SEQ ID NO: 18283 - protein, 18 aa, Drosophila melanogaster
REFFLSFAKDPQMFIHRW

SEQ ID NO: 18284 - protein, 18 aa, Drosophila melanogaster
REFFLSFAKDPQMFIHRW

SEQ ID NO: 18285 - protein, 18 aa, Drosophila melanogaster
REFFLSFAKDPQMFIHRW

SEQ ID NO: 18286 - protein, 18 aa, Drosophila melanogaster
REFFLSFAKDPQMFIHRW

SEQ ID NO: 18287 - protein, 18 aa, Drosophila melanogaster
REFFLSFAKDPQMFIHRW

SEQ ID NO: 18288 - protein, 18 aa, Drosophila melanogaster
REFFLSFAKDPQMFIHRW

SEQ ID NO: 18289 - protein, 18 aa, Drosophila melanogaster
REFFLSFAKDPQMFIHRW

SEQ ID NO: 18290 - protein, 18 aa, Drosophila melanogaster
REFFLSFAKDPQMFIHRW

SEQ ID NO: 18291 - protein, 18 aa, Drosophila melanogaster
REFFLSFAKDPQMFIHRW

SEQ ID NO: 18292 - protein, 9 aa, Drosophila melanogaster
KKLEIKLRH

SEQ ID NO: 18293 - protein, 16 aa, Drosophila melanogaster
RQQFHLEQLKAAEFRA

SEQ ID NO: 18294 - protein, 16 aa, Drosophila melanogaster
RLLEDGKGDPNTKIKR

SEQ ID NO: 18295 - protein, 16 aa, Drosophila melanogaster
RLLEDGKGDPNTKIKR

SEQ ID NO: 18296 - protein, 9 aa, Drosophila melanogaster
RGWLDKLRA

SEQ ID NO: 18297 - protein, 12 aa, Drosophila melanogaster
RGGGSKSQHERR

SEQ ID NO: 18298 - protein, 12 aa, Drosophila melanogaster
RATEKLEKQQKL

SEQ ID NO: 18299 - protein, 12 aa, Drosophila melanogaster
RATEKLEKQQKL

SEQ ID NO: 18300 - protein, 15 aa, Drosophila melanogaster
KVKTDVDMHETPSRG

SEQ ID NO: 18301 - protein, 28 aa, Drosophila melanogaster
RRIDIQPAEDEDDQDEGYTTKHLAYARY

SEQ ID NO: 18302 - protein, 28 aa, Drosophila melanogaster
RRIDIQPAEDEDDQDEGYTTKHLAYARY

SEQ ID NO: 18303 - protein, 28 aa, Drosophila melanogaster
RRIDIQPAEDEDDQDEGYTTKHLAYARY

SEQ ID NO: 18304 - protein, 28 aa, Drosophila melanogaster
RRIDIQPAEDEDDQDEGYTTKHLAYARY

SEQ ID NO: 18305 - protein, 28 aa, Drosophila melanogaster
RRIDIQPAEDEDDQDEGYTTKHLAYARY

SEQ ID NO: 18306 - protein, 28 aa, Drosophila melanogaster
RRIDIQPAEDEDDQDEGYTTKHLAYARY

SEQ ID NO: 18307 - protein, 28 aa, Drosophila melanogaster
RRIDIQPAEDEDDQDEGYTTKHLAYARY

SEQ ID NO: 18308 - protein, 28 aa, Drosophila melanogaster
RRIDIQPAEDEDDQDEGYTTKHLAYARY

SEQ ID NO: 18309 - protein, 28 aa, Drosophila melanogaster
RRIDIQPAEDEDDQDEGYTTKHLAYARY

SEQ ID NO: 18310 - protein, 28 aa, Drosophila melanogaster
RRIDIQPAEDEDDQDEGYTTKHLAYARY

SEQ ID NO: 18311 - protein, 28 aa, Drosophila melanogaster
RRIDIQPAEDEDDQDEGYTTKHLAYARY

SEQ ID NO: 18312 - protein, 28 aa, Drosophila melanogaster
RRIDIQPAEDEDDQDEGYTTKHLAYARY

SEQ ID NO: 18313 - protein, 28 aa, Drosophila melanogaster
RRIDIQPAEDEDDQDEGYTTKHLAYARY

SEQ ID NO: 18314 - protein, 17 aa, Drosophila melanogaster
RSLGGGGSKSDFATAKK

SEQ ID NO: 18315 - protein, 17 aa, Drosophila melanogaster
KIHETVDTINQMKTNRE

SEQ ID NO: 18316 - protein, 17 aa, Drosophila melanogaster
KIHETVDTINQMKTNRE

SEQ ID NO: 18317 - protein, 17 aa, Drosophila melanogaster
KIHETVDTINQMKTNRE

SEQ ID NO: 18318 - protein, 17 aa, Drosophila melanogaster
KIHETVDTINQMKTNRE

SEQ ID NO: 18319 - protein, 19 aa, Drosophila melanogaster
RGTGAGGGGVGSGGGSKRS

SEQ ID NO: 18320 - protein, 19 aa, Drosophila melanogaster
RGTGAGGGGVGSGGGSKRS

SEQ ID NO: 18321 - protein, 12 aa, Drosophila melanogaster
RGGGSKSQHERR

SEQ ID NO: 18322 - protein, 12 aa, Drosophila melanogaster
RGGGSKSQHERR

SEQ ID NO: 18323 - protein, 14 aa, Drosophila melanogaster
RLDIQEALKRPMKQ

SEQ ID NO: 18324 - protein, 14 aa, Drosophila melanogaster
RLDIQEALKRPMKQ

SEQ ID NO: 18325 - protein, 12 aa, Drosophila melanogaster
RGGGSKSQHERR

SEQ ID NO: 18326 - protein, 10 aa, Drosophila melanogaster
RTTAKDEARV

SEQ ID NO: 18327 - protein, 17 aa, Drosophila melanogaster
KLEAELQQMEEKFEAKK

SEQ ID NO: 18328 - protein, 18 aa, Drosophila melanogaster
KLEAELQQMEEKFEAKKQ

SEQ ID NO: 18329 - protein, 18 aa, Drosophila melanogaster
KLEAELQQMEEKFEAKKQ

SEQ ID NO: 18330 - protein, 18 aa, Drosophila melanogaster
KLEAELQQMEEKFEAKKQ

SEQ ID NO: 18331 - protein, 17 aa, Drosophila melanogaster
KLEAELQQMEEKFEAKK

SEQ ID NO: 18332 - protein, 17 aa, Drosophila melanogaster
KLEAELQQMEEKFEAKK

SEQ ID NO: 18333 - protein, 9 aa, Drosophila melanogaster
KKLEIKLRH

SEQ ID NO: 18334 - protein, 9 aa, Drosophila melanogaster
KKLEIKLRH

SEQ ID NO: 18335 - protein, 9 aa, Drosophila melanogaster
KKLEIKLRH

SEQ ID NO: 18336 - protein, 12 aa, Drosophila melanogaster
KAKHLAALEERK

SEQ ID NO: 18337 - protein, 12 aa, Drosophila melanogaster
KAKHLAALEERK

SEQ ID NO: 18338 - protein, 12 aa, Drosophila melanogaster
RGGGSKSQHERR

SEQ ID NO: 18339 - protein, 16 aa, Drosophila melanogaster
RQQFHLEQLKAAEFRA

SEQ ID NO: 18340 - protein, 16 aa, Drosophila melanogaster
RQQFHLEQLKAAEFRA

SEQ ID NO: 18341 - protein, 16 aa, Drosophila melanogaster
RQQFHLEQLKAAEFRA

SEQ ID NO: 18342 - protein, 16 aa, Drosophila melanogaster
RQQFHLEQLKAAEFRA

SEQ ID NO: 18343 - protein, 13 aa, Drosophila melanogaster
PLGKDGGLELGDK

SEQ ID NO: 18344 - protein, 15 aa, Drosophila melanogaster
AIDSMEEKGLQEDPR

SEQ ID NO: 18345 - protein, 15 aa, Drosophila melanogaster
AIDSMEEKGLQEDPR

SEQ ID NO: 18346 - protein, 15 aa, Drosophila melanogaster
AIDSMEEKGLQEDPR

SEQ ID NO: 18347 - protein, 15 aa, Drosophila melanogaster
AIDSMEEKGLQEDPR

SEQ ID NO: 18348 - protein, 15 aa, Drosophila melanogaster
AIDSMEEKGLQEDPR

SEQ ID NO: 18349 - protein, 15 aa, Drosophila melanogaster
AIDSMEEKGLQEDPR

SEQ ID NO: 18350 - protein, 15 aa, Drosophila melanogaster
AIDSMEEKGLQEDPR

SEQ ID NO: 18351 - protein, 15 aa, Drosophila melanogaster
AIDSMEEKGLQEDPR

SEQ ID NO: 18352 - protein, 15 aa, Drosophila melanogaster
AIDSMEEKGLQEDPR

SEQ ID NO: 18353 - protein, 15 aa, Drosophila melanogaster
AIDSMEEKGLQEDPR

SEQ ID NO: 18354 - protein, 15 aa, Drosophila melanogaster
AIDSMEEKGLQEDPR

SEQ ID NO: 18355 - protein, 15 aa, Drosophila melanogaster
AIDSMEEKGLQEDPR

SEQ ID NO: 18356 - protein, 15 aa, Drosophila melanogaster
AIDSMEEKGLQEDPR

SEQ ID NO: 18357 - protein, 15 aa, Drosophila melanogaster
AIDSMEEKGLQEDPR

SEQ ID NO: 18358 - protein, 16 aa, Drosophila melanogaster
HLEFLAAVLQHGKDLR

SEQ ID NO: 18359 - protein, 16 aa, Drosophila melanogaster
HLEFLAAVLQHGKDLR

SEQ ID NO: 18360 - protein, 28 aa, Drosophila melanogaster
TFPMCFDDTDPTASLENAAQKECLVPIR

SEQ ID NO: 18361 - protein, 11 aa, Drosophila melanogaster
AMPEFFNSKNK

SEQ ID NO: 18362 - protein, 9 aa, Drosophila melanogaster
LDIQEALKR

SEQ ID NO: 18363 - protein, 9 aa, Drosophila melanogaster
LDIQEALKR

SEQ ID NO: 18364 - protein, 9 aa, Drosophila melanogaster
LDIQEALKR

SEQ ID NO: 18365 - protein, 17 aa, Drosophila melanogaster
GTGAGGGGVGSGGGSKR

SEQ ID NO: 18366 - protein, 17 aa, Drosophila melanogaster
GTGAGGGGVGSGGGSKR

SEQ ID NO: 18367 - protein, 17 aa, Drosophila melanogaster
GTGAGGGGVGSGGGSKR

SEQ ID NO: 18368 - protein, 17 aa, Drosophila melanogaster
GTGAGGGGVGSGGGSKR

SEQ ID NO: 18369 - protein, 10 aa, Drosophila melanogaster
LEKLCAVLTR

SEQ ID NO: 18370 - protein, 15 aa, Drosophila melanogaster
IHETVDTINQMKTNR

SEQ ID NO: 18371 - protein, 15 aa, Drosophila melanogaster
IHETVDTINQMKTNR

SEQ ID NO: 18372 - protein, 15 aa, Drosophila melanogaster
IHETVDTINQMKTNR

SEQ ID NO: 18373 - protein, 15 aa, Drosophila melanogaster
IHETVDTINQMKTNR

SEQ ID NO: 18374 - protein, 14 aa, Drosophila melanogaster
QQFHLEQLKAAEFR

SEQ ID NO: 18375 - protein, 14 aa, Drosophila melanogaster
QQFHLEQLKAAEFR

SEQ ID NO: 18376 - protein, 14 aa, Drosophila melanogaster
QQFHLEQLKAAEFR

SEQ ID NO: 18377 - protein, 14 aa, Drosophila melanogaster
QQFHLEQLKAAEFR

SEQ ID NO: 18378 - protein, 14 aa, Drosophila melanogaster
QQFHLEQLKAAEFR

SEQ ID NO: 18379 - protein, 14 aa, Drosophila melanogaster
QQFHLEQLKAAEFR

SEQ ID NO: 18380 - protein, 14 aa, Drosophila melanogaster
QQFHLEQLKAAEFR

SEQ ID NO: 18381 - protein, 14 aa, Drosophila melanogaster
QQFHLEQLKAAEFR

SEQ ID NO: 18382 - protein, 14 aa, Drosophila melanogaster
QQFHLEQLKAAEFR

SEQ ID NO: 18383 - protein, 14 aa, Drosophila melanogaster
QQFHLEQLKAAEFR

SEQ ID NO: 18384 - protein, 14 aa, Drosophila melanogaster
QQFHLEQLKAAEFR

SEQ ID NO: 18385 - protein, 14 aa, Drosophila melanogaster
QQFHLEQLKAAEFR

SEQ ID NO: 18386 - protein, 14 aa, Drosophila melanogaster
QQFHLEQLKAAEFR

SEQ ID NO: 18387 - protein, 14 aa, Drosophila melanogaster
QQFHLEQLKAAEFR

SEQ ID NO: 18388 - protein, 14 aa, Drosophila melanogaster
QQFHLEQLKAAEFR

SEQ ID NO: 18389 - protein, 14 aa, Drosophila melanogaster
QQFHLEQLKAAEFR

SEQ ID NO: 18390 - protein, 14 aa, Drosophila melanogaster
QQFHLEQLKAAEFR

SEQ ID NO: 18391 - protein, 14 aa, Drosophila melanogaster
QQFHLEQLKAAEFR

SEQ ID NO: 18392 - protein, 14 aa, Drosophila melanogaster
QQFHLEQLKAAEFR

SEQ ID NO: 18393 - protein, 14 aa, Drosophila melanogaster
QQFHLEQLKAAEFR

SEQ ID NO: 18394 - protein, 40 aa, Drosophila melanogaster
LNPLLHPPDPIVINHFIESGAENKQTACYDIDVEVDDTLK

SEQ ID NO: 18395 - protein, 40 aa, Drosophila melanogaster; identical to SEQ ID NO: 18394

SEQ ID NO: 18396 - protein, 40 aa, Drosophila melanogaster; identical to SEQ ID NO: 18394

SEQ ID NO: 18397 - protein, 10 aa, Drosophila melanogaster
AKHLAALEER

SEQ ID NO: 18398 - protein, 10 aa, Drosophila melanogaster
AKHLAALEER

SEQ ID NO: 18399 - protein, 10 aa, Drosophila melanogaster
AKHLAALEER

SEQ ID NO: 18400 - protein, 10 aa, Drosophila melanogaster
AKHLAALEER

SEQ ID NO: 18401 - protein, 11 aa, Drosophila melanogaster
AKHLAALEERK

SEQ ID NO: 18402 - protein, 7 aa, Drosophila melanogaster
ILPQKVR

SEQ ID NO: 18403 - protein, 14 aa, Drosophila melanogaster
QQFHLEQLKAAEFR

SEQ ID NO: 18404 - protein, 14 aa, Drosophila melanogaster
QQFHLEQLKAAEFR

SEQ ID NO: 18405 - protein, 14 aa, Drosophila melanogaster
QQFHLEQLKAAEFR

SEQ ID NO: 18406 - protein, 14 aa, Drosophila melanogaster
QQFHLEQLKAAEFR

SEQ ID NO: 18407 - protein, 14 aa, Drosophila melanogaster
QQFHLEQLKAAEFR

SEQ ID NO: 18408 - protein, 9 aa, Drosophila melanogaster
MKFAEIPQR

SEQ ID NO: 18409 - protein, 9 aa, Drosophila melanogaster
LAEKILPQK

SEQ ID NO: 18410 - protein, 7 aa, Drosophila melanogaster
KLEIKLR

SEQ ID NO: 18411 - protein, 14 aa, Drosophila melanogaster
QQFHLEQLKAAEFR

SEQ ID NO: 18412 - protein, 18 aa, Drosophila melanogaster
THTTQETDGFQVKRPGDR

SEQ ID NO: 18413 - protein, 18 aa, Drosophila melanogaster
THTTQETDGFQVKRPGDR

SEQ ID NO: 18414 - protein, 18 aa, Drosophila melanogaster
THTTQETDGFQVKRPGDR

SEQ ID NO: 18415 - protein, 14 aa, Drosophila melanogaster
QQFHLEQLKAAEFR

SEQ ID NO: 18416 - protein, 7 aa, Drosophila melanogaster
KFSSFFK

SEQ ID NO: 18417 - protein, 17 aa, Drosophila melanogaster
EYINCDKYLEQIFSCQR

SEQ ID NO: 18418 - protein, 14 aa, Drosophila melanogaster
QQFHLEQLKAAEFR

SEQ ID NO: 18419 - protein, 9 aa, Drosophila melanogaster
YFFTKVNQK

SEQ ID NO: 18420 - protein, 9 aa, Drosophila melanogaster
YFFTKVNQK

SEQ ID NO: 18421 - protein, 17 aa, Drosophila melanogaster
IPYIYIRPEIEKGFEGK

SEQ ID NO: 18422 - protein, 17 aa, Drosophila melanogaster
IPYIYIRPEIEKGFEGK

SEQ ID NO: 18423 - protein, 17 aa, Drosophila melanogaster
IPYIYIRPEIEKGFEGK

SEQ ID NO: 18424 - protein, 14 aa, Drosophila melanogaster
QQFHLEQLKAAEFR

SEQ ID NO: 18425 - protein, 17 aa, Drosophila melanogaster
GTGAGGGGVGSGGGSKR

SEQ ID NO: 18426 - protein, 17 aa, Drosophila melanogaster
GTGAGGGGVGSGGGSKR

SEQ ID NO: 18427 - protein, 17 aa, Drosophila melanogaster
GTGAGGGGVGSGGGSKR

SEQ ID NO: 18428 - protein, 17 aa, Drosophila melanogaster
GTGAGGGGVGSGGGSKR

SEQ ID NO: 18429 - protein, 13 aa, Drosophila melanogaster
KSRNDDDDEDLTR

SEQ ID NO: 18430 - protein, 13 aa, Drosophila melanogaster
KSRNDDDDEDLTR

SEQ ID NO: 18431 - protein, 18 aa, Drosophila melanogaster
ANAALQSTASPAPGGKSR

SEQ ID NO: 18432 - protein, 17 aa, Drosophila melanogaster
GTGAGGGGVGSGGGSKR

SEQ ID NO: 18433 - protein, 17 aa, Drosophila melanogaster
GTGAGGGGVGSGGGSKR

SEQ ID NO: 18434 - protein, 17 aa, Drosophila melanogaster
GTGAGGGGVGSGGGSKR

SEQ ID NO: 18435 - protein, 17 aa, Drosophila melanogaster
GTGAGGGGVGSGGGSKR

SEQ ID NO: 18436 - protein, 17 aa, Drosophila melanogaster
IPYIYIRPEIEKGFEGK

SEQ ID NO: 18437 - protein, 14 aa, Drosophila melanogaster
QQFHLEQLKAAEFR

SEQ ID NO: 18438 - protein, 14 aa, Drosophila melanogaster
QQFHLEQLKAAEFR

SEQ ID NO: 18439 - protein, 14 aa, Drosophila melanogaster
QQFHLEQLKAAEFR

SEQ ID NO: 18440 - protein, 14 aa, Drosophila melanogaster
QQFHLEQLKAAEFR

SEQ ID NO: 18441 - protein, 14 aa, Drosophila melanogaster
QQFHLEQLKAAEFR

SEQ ID NO: 18442 - protein, 14 aa, Drosophila melanogaster
QQFHLEQLKAAEFR

SEQ ID NO: 18443 - protein, 14 aa, Drosophila melanogaster
QQFHLEQLKAAEFR

SEQ ID NO: 18444 - protein, 14 aa, Drosophila melanogaster
QQFHLEQLKAAEFR

SEQ ID NO: 18445 - protein, 14 aa, Drosophila melanogaster
QQFHLEQLKAAEFR

SEQ ID NO: 18446 - protein, 14 aa, Drosophila melanogaster
QQFHLEQLKAAEFR

SEQ ID NO: 18447 - protein, 14 aa, Drosophila melanogaster
QQFHLEQLKAAEFR

SEQ ID NO: 18448 - protein, 14 aa, Drosophila melanogaster
QQFHLEQLKAAEFR

SEQ ID NO: 18449 - protein, 14 aa, Drosophila melanogaster
QQFHLEQLKAAEFR

SEQ ID NO: 18450 - protein, 14 aa, Drosophila melanogaster
QQFHLEQLKAAEFR

SEQ ID NO: 18451 - protein, 14 aa, Drosophila melanogaster
QQFHLEQLKAAEFR

SEQ ID NO: 18452 - protein, 12 aa, Drosophila melanogaster
LDQYAKKPAAMR

SEQ ID NO: 18453 - protein, 12 aa, Drosophila melanogaster
LDQYAKKPAAMR

SEQ ID NO: 18454 - protein, 8 aa, Drosophila melanogaster
KLDATIMR

SEQ ID NO: 18455 - protein, 12 aa, Drosophila melanogaster
TLLDLDKKPLGK

SEQ ID NO: 18456 - protein, 8 aa, Drosophila melanogaster
KLDATIMR

SEQ ID NO: 18457 - protein, 16 aa, Drosophila melanogaster
EFFLSFAKDPQMFIHR

SEQ ID NO: 18458 - protein, 16 aa, Drosophila melanogaster
EFFLSFAKDPQMFIHR

SEQ ID NO: 18459 - protein, 16 aa, Drosophila melanogaster
EFFLSFAKDPQMFIHR

SEQ ID NO: 18460 - protein, 16 aa, Drosophila melanogaster
EFFLSFAKDPQMFIHR

SEQ ID NO: 18461 - protein, 16 aa, Drosophila melanogaster
EFFLSFAKDPQMFIHR

SEQ ID NO: 18462 - protein, 16 aa, Drosophila melanogaster
EFFLSFAKDPQMFIHR

SEQ ID NO: 18463 - protein, 16 aa, Drosophila melanogaster
EFFLSFAKDPQMFIHR

SEQ ID NO: 18464 - protein, 16 aa, Drosophila melanogaster
EFFLSFAKDPQMFIHR

SEQ ID NO: 18465 - protein, 16 aa, Drosophila melanogaster
EFFLSFAKDPQMFIHR

SEQ ID NO: 18466 - protein, 16 aa, Drosophila melanogaster
EFFLSFAKDPQMFIHR

SEQ ID NO: 18467 - protein, 16 aa, Drosophila melanogaster
EFFLSFAKDPQMFIHR

SEQ ID NO: 18468 - protein, 16 aa, Drosophila melanogaster
EFFLSFAKDPQMFIHR

SEQ ID NO: 18469 - protein, 16 aa, Drosophila melanogaster
EFFLSFAKDPQMFIHR

SEQ ID NO: 18470 - protein, 16 aa, Drosophila melanogaster
EFFLSFAKDPQMFIHR

SEQ ID NO: 18471 - protein, 16 aa, Drosophila melanogaster
EFFLSFAKDPQMFIHR

SEQ ID NO: 18472 - protein, 16 aa, Drosophila melanogaster
EFFLSFAKDPQMFIHR

SEQ ID NO: 18473 - protein, 16 aa, Drosophila melanogaster
EFFLSFAKDPQMFIHR

SEQ ID NO: 18474 - protein, 16 aa, Drosophila melanogaster
EFFLSFAKDPQMFIHR

SEQ ID NO: 18475 - protein, 16 aa, Drosophila melanogaster
EFFLSFAKDPQMFIHR

SEQ ID NO: 18476 - protein, 16 aa, Drosophila melanogaster
EFFLSFAKDPQMFIHR

SEQ ID NO: 18477 - protein, 16 aa, Drosophila melanogaster
EFFLSFAKDPQMFIHR

SEQ ID NO: 18478 - protein, 16 aa, Drosophila melanogaster
EFFLSFAKDPQMFIHR

SEQ ID NO: 18479 - protein, 16 aa, Drosophila melanogaster
EFFLSFAKDPQMFIHR

SEQ ID NO: 18480 - protein, 16 aa, Drosophila melanogaster
EFFLSFAKDPQMFIHR

SEQ ID NO: 18481 - protein, 7 aa, Drosophila melanogaster
KLEIKLR

SEQ ID NO: 18482 - protein, 14 aa, Drosophila melanogaster
QQFHLEQLKAAEFR

SEQ ID NO: 18483 - protein, 14 aa, Drosophila melanogaster
LLEDGKGDPNTKIK

SEQ ID NO: 18484 - protein, 14 aa, Drosophila melanogaster
LLEDGKGDPNTKIK

SEQ ID NO: 18485 - protein, 7 aa, Drosophila melanogaster
GWLDKLR

SEQ ID NO: 18486 - protein, 10 aa, Drosophila melanogaster
GGGSKSQHER

SEQ ID NO: 18487 - protein, 10 aa, Drosophila melanogaster
ATEKLEKQQK

SEQ ID NO: 18488 - protein, 10 aa, Drosophila melanogaster
ATEKLEKQQK

SEQ ID NO: 18489 - protein, 13 aa, Drosophila melanogaster
VKTDVDMHETPSR

SEQ ID NO: 18490 - protein, 26 aa, Drosophila melanogaster
RIDIQPAEDEDDQDEGYTTKHLAYAR

SEQ ID NO: 18491 - protein, 26 aa, Drosophila melanogaster
RIDIQPAEDEDDQDEGYTTKHLAYAR

SEQ ID NO: 18492 - protein, 26 aa, Drosophila melanogaster
RIDIQPAEDEDDQDEGYTTKHLAYAR

SEQ ID NO: 18493 - protein, 26 aa, Drosophila melanogaster
RIDIQPAEDEDDQDEGYTTKHLAYAR

SEQ ID NO: 18494 - protein, 26 aa, Drosophila melanogaster
RIDIQPAEDEDDQDEGYTTKHLAYAR

SEQ ID NO: 18495 - protein, 26 aa, Drosophila melanogaster
RIDIQPAEDEDDQDEGYTTKHLAYAR

SEQ ID NO: 18496 - protein, 26 aa, Drosophila melanogaster
RIDIQPAEDEDDQDEGYTTKHLAYAR

SEQ ID NO: 18497 - protein, 26 aa, Drosophila melanogaster
RIDIQPAEDEDDQDEGYTTKHLAYAR

SEQ ID NO: 18498 - protein, 26 aa, Drosophila melanogaster
RIDIQPAEDEDDQDEGYTTKHLAYAR

SEQ ID NO: 18499 - protein, 26 aa, Drosophila melanogaster
RIDIQPAEDEDDQDEGYTTKHLAYAR

SEQ ID NO: 18500 - protein, 26 aa, Drosophila melanogaster
RIDIQPAEDEDDQDEGYTTKHLAYAR

SEQ ID NO: 18501 - protein, 26 aa, Drosophila melanogaster
RIDIQPAEDEDDQDEGYTTKHLAYAR

SEQ ID NO: 18502 - protein, 26 aa, Drosophila melanogaster
RIDIQPAEDEDDQDEGYTTKHLAYAR

SEQ ID NO: 18503 - protein, 15 aa, Drosophila melanogaster
SLGGGGSKSDFATAK

SEQ ID NO: 18504 - protein, 15 aa, Drosophila melanogaster
IHETVDTINQMKTNR

SEQ ID NO: 18505 - protein, 15 aa, Drosophila melanogaster
IHETVDTINQMKTNR

SEQ ID NO: 18506 - protein, 15 aa, Drosophila melanogaster
IHETVDTINQMKTNR

SEQ ID NO: 18507 - protein, 15 aa, Drosophila melanogaster
IHETVDTINQMKTNR

SEQ ID NO: 18508 - protein, 17 aa, Drosophila melanogaster
GTGAGGGGVGSGGGSKR

SEQ ID NO: 18509 - protein, 17 aa, Drosophila melanogaster
GTGAGGGGVGSGGGSKR

SEQ ID NO: 18510 - protein, 10 aa, Drosophila melanogaster
GGGSKSQHER

SEQ ID NO: 18511 - protein, 10 aa, Drosophila melanogaster
GGGSKSQHER

SEQ ID NO: 18512 - protein, 12 aa, Drosophila melanogaster
LDIQEALKRPMK

SEQ ID NO: 18513 - protein, 12 aa, Drosophila melanogaster
LDIQEALKRPMK

SEQ ID NO: 18514 - protein, 10 aa, Drosophila melanogaster
GGGSKSQHER

SEQ ID NO: 18515 - protein, 8 aa, Drosophila melanogaster
TTAKDEAR

SEQ ID NO: 18516 - protein, 15 aa, Drosophila melanogaster
LEAELQQMEEKFEAK

SEQ ID NO: 18517 - protein, 16 aa, Drosophila melanogaster
LEAELQQMEEKFEAKK

SEQ ID NO: 18518 - protein, 16 aa, Drosophila melanogaster
LEAELQQMEEKFEAKK

SEQ ID NO: 18519 - protein, 16 aa, Drosophila melanogaster
LEAELQQMEEKFEAKK

SEQ ID NO: 18520 - protein, 15 aa, Drosophila melanogaster
LEAELQQMEEKFEAK

SEQ ID NO: 18521 - protein, 15 aa, Drosophila melanogaster
LEAELQQMEEKFEAK

SEQ ID NO: 18522 - protein, 7 aa, Drosophila melanogaster
KLEIKLR

SEQ ID NO: 18523 - protein, 7 aa, Drosophila melanogaster
KLEIKLR

SEQ ID NO: 18524 - protein, 7 aa, Drosophila melanogaster
KLEIKLR

SEQ ID NO: 18525 - protein, 10 aa, Drosophila melanogaster
AKHLAALEER

SEQ ID NO: 18526 - protein, 10 aa, Drosophila melanogaster
AKHLAALEER

SEQ ID NO: 18527 - protein, 10 aa, Drosophila melanogaster
GGGSKSQHER

SEQ ID NO: 18528 - protein, 14 aa, Drosophila melanogaster
QQFHLEQLKAAEFR

SEQ ID NO: 18529 - protein, 14 aa, Drosophila melanogaster
QQFHLEQLKAAEFR

SEQ ID NO: 18530 - protein, 14 aa, Drosophila melanogaster
QQFHLEQLKAAEFR

SEQ ID NO: 18531 - protein, 14 aa, Drosophila melanogaster
QQFHLEQLKAAEFR

SEQ ID NO: 18532 - protein, 9 aa, Drosophila melanogaster
KDLITKAKV

SEQ ID NO: 18533 - protein, 16 aa, Drosophila melanogaster
RKAMGMSYAGLPPPRP

SEQ ID NO: 18534 - protein, 16 aa, Drosophila melanogaster
RKAMGMSYAGLPPPRP

SEQ ID NO: 18535 - protein, 16 aa, Drosophila melanogaster
RKAMGMSYAGLPPPRP

SEQ ID NO: 18536 - protein, 16 aa, Drosophila melanogaster
RKAMGMSYAGLPPPRP

SEQ ID NO: 18537 - protein, 16 aa, Drosophila melanogaster
RKAMGMSYAGLPPPRP

SEQ ID NO: 18538 - protein, 16 aa, Drosophila melanogaster
RKAMGMSYAGLPPPRP

SEQ ID NO: 18539 - protein, 16 aa, Drosophila melanogaster
RKAMGMSYAGLPPPRP

SEQ ID NO: 18540 - protein, 16 aa, Drosophila melanogaster
RKAMGMSYAGLPPPRP

SEQ ID NO: 18541 - protein, 16 aa, Drosophila melanogaster
RKAMGMSYAGLPPPRP

SEQ ID NO: 18542 - protein, 16 aa, Drosophila melanogaster
RKAMGMSYAGLPPPRP

SEQ ID NO: 18543 - protein, 16 aa, Drosophila melanogaster
RKAMGMSYAGLPPPRP

SEQ ID NO: 18544 - protein, 16 aa, Drosophila melanogaster
RKAMGMSYAGLPPPRP

SEQ ID NO: 18545 - protein, 16 aa, Drosophila melanogaster
RKAMGMSYAGLPPPRP

SEQ ID NO: 18546 - protein, 16 aa, Drosophila melanogaster
RKAMGMSYAGLPPPRP

SEQ ID NO: 18547 - protein, 14 aa, Drosophila melanogaster
RLKMISANGSVERR

SEQ ID NO: 18548 - protein, 14 aa, Drosophila melanogaster
RLKMISANGSVERR

SEQ ID NO: 18549 - protein, 6 aa, Drosophila melanogaster
KNKSKT

SEQ ID NO: 18550 - protein, 9 aa, Drosophila melanogaster
KDALKMLKL

SEQ ID NO: 18551 - protein, 9 aa, Drosophila melanogaster
KDLITKAKV

SEQ ID NO: 18552 - protein, 9 aa, Drosophila melanogaster
KDLITKAKV

SEQ ID NO: 18553 - protein, 6 aa, Drosophila melanogaster
REQKKE

SEQ ID NO: 18554 - protein, 7 aa, Drosophila melanogaster
RVHTKKV

SEQ ID NO: 18555 - protein, 9 aa, Drosophila melanogaster
KKIRDQDRN

SEQ ID NO: 18556 - protein, 9 aa, Drosophila melanogaster
KKIRDQDRN

SEQ ID NO: 18557 - protein, 9 aa, Drosophila melanogaster
KKIRDQDRN

SEQ ID NO: 18558 - protein, 10 aa, Drosophila melanogaster
RKLDATIMRK

SEQ ID NO: 18559 - protein, 17 aa, Drosophila melanogaster
RKIKSLVALLVETQMKK

SEQ ID NO: 18560 - protein, 17 aa, Drosophila melanogaster
RKIKSLVALLVETQMKK

SEQ ID NO: 18561 - protein, 17 aa, Drosophila melanogaster
RKIKSLVALLVETQMKK

SEQ ID NO: 18562 - protein, 8 aa, Drosophila melanogaster
KKPAAMRN

SEQ ID NO: 18563 - protein, 12 aa, Drosophila melanogaster
KTHKLQDAHERE

SEQ ID NO: 18564 - protein, 12 aa, Drosophila melanogaster
KTHKLQDAHERE

SEQ ID NO: 18565 - protein, 12 aa, Drosophila melanogaster
KTHKLQDAHERE

SEQ ID NO: 18566 - protein, 12 aa, Drosophila melanogaster
KTHKLQDAHERE

SEQ ID NO: 18567 - protein, 12 aa, Drosophila melanogaster
KTHKLQDAHERE

SEQ ID NO: 18568 - protein, 12 aa, Drosophila melanogaster
KTHKLQDAHERE

SEQ ID NO: 18569 - protein, 12 aa, Drosophila melanogaster
KTHKLQDAHERE

SEQ ID NO: 18570 - protein, 12 aa, Drosophila melanogaster
KTHKLQDAHERE

SEQ ID NO: 18571 - protein, 12 aa, Drosophila melanogaster
KTHKLQDAHERE

SEQ ID NO: 18572 - protein, 12 aa, Drosophila melanogaster
KTHKLQDAHERE

SEQ ID NO: 18573 - protein, 12 aa, Drosophila melanogaster
KTHKLQDAHERE

SEQ ID NO: 18574 - protein, 12 aa, Drosophila melanogaster
KTHKLQDAHERE

SEQ ID NO: 18575 - protein, 12 aa, Drosophila melanogaster
KTHKLQDAHERE

SEQ ID NO: 18576 - protein, 12 aa, Drosophila melanogaster
KTHKLQDAHERE

SEQ ID NO: 18577 - protein, 12 aa, Drosophila melanogaster
KTHKLQDAHERE

SEQ ID NO: 18578 - protein, 12 aa, Drosophila melanogaster
KTHKLQDAHERE

SEQ ID NO: 18579 - protein, 12 aa, Drosophila melanogaster
KTHKLQDAHERE

SEQ ID NO: 18580 - protein, 12 aa, Drosophila melanogaster
KTHKLQDAHERE

SEQ ID NO: 18581 - protein, 12 aa, Drosophila melanogaster
KTHKLQDAHERE

SEQ ID NO: 18582 - protein, 12 aa, Drosophila melanogaster
KTHKLQDAHERE

SEQ ID NO: 18583 - protein, 20 aa, Drosophila melanogaster
KANAALQSTASPAPGGKSRG

SEQ ID NO: 18584 - protein, 20 aa, Drosophila melanogaster
KANAALQSTASPAPGGKSRG

SEQ ID NO: 18585 - protein, 20 aa, Drosophila melanogaster
KANAALQSTASPAPGGKSRG

SEQ ID NO: 18586 - protein, 9 aa, Drosophila melanogaster
KILPQKVRD

SEQ ID NO: 18587 - protein, 9 aa, Drosophila melanogaster
KILPQKVRD

SEQ ID NO: 18588 - protein, 9 aa, Drosophila melanogaster
KILPQKVRD

SEQ ID NO: 18589 - protein, 9 aa, Drosophila melanogaster
KILPQKVRD

SEQ ID NO: 18590 - protein, 9 aa, Drosophila melanogaster
KILPQKVRD

SEQ ID NO: 18591 - protein, 8 aa, Drosophila melanogaster
KKPAAMRN

SEQ ID NO: 18592 - protein, 11 aa, Drosophila melanogaster
RMKFAEIPQRL

SEQ ID NO: 18593 - protein, 11 aa, Drosophila melanogaster
RMKFAEIPQRL

SEQ ID NO: 18594 - protein, 11 aa, Drosophila melanogaster
RMKFAEIPQRL

SEQ ID NO: 18595 - protein, 11 aa, Drosophila melanogaster
RMKFAEIPQRL

SEQ ID NO: 18596 - protein, 11 aa, Drosophila melanogaster
RMKFAEIPQRL

SEQ ID NO: 18597 - protein, 9 aa, Drosophila melanogaster
KGFEGKLRE

SEQ ID NO: 18598 - protein, 9 aa, Drosophila melanogaster
KKLEIKLRH

SEQ ID NO: 18599 - protein, 7 aa, Drosophila melanogaster
KVNQKRA

SEQ ID NO: 18600 - protein, 7 aa, Drosophila melanogaster
KVNQKRA

SEQ ID NO: 18601 - protein, 6 aa, Drosophila melanogaster
KNKSKT

SEQ ID NO: 18602 - protein, 14 aa, Drosophila melanogaster
KTLLDLDKKPLGKD

SEQ ID NO: 18603 - protein, 8 aa, Drosophila melanogaster
KKPAAMRN

SEQ ID NO: 18604 - protein, 14 aa, Drosophila melanogaster
RLLEDGKGDPNTKI

SEQ ID NO: 18605 - protein, 7 aa, Drosophila melanogaster
KTHKQRM

SEQ ID NO: 18606 - protein, 16 aa, Drosophila melanogaster
RQQFHLEQLKAAEFRA

SEQ ID NO: 18607 - protein, 11 aa, Drosophila melanogaster
RYFFTKVNQKR

SEQ ID NO: 18608 - protein, 12 aa, Drosophila melanogaster
KAKHLAALEERK

SEQ ID NO: 18609 - protein, 12 aa, Drosophila melanogaster
KAKHLAALEERK

SEQ ID NO: 18610 - protein, 19 aa, Drosophila melanogaster
RGTGAGGGGVGSGGGSKRS

SEQ ID NO: 18611 - protein, 19 aa, Drosophila melanogaster
RGTGAGGGGVGSGGGSKRS

SEQ ID NO: 18612 - protein, 19 aa, Drosophila melanogaster
RGTGAGGGGVGSGGGSKRS

SEQ ID NO: 18613 - protein, 19 aa, Drosophila melanogaster
RGTGAGGGGVGSGGGSKRS

SEQ ID NO: 18614 - protein, 6 aa, Drosophila melanogaster
IKTHKL

SEQ ID NO: 18615 - protein, 10 aa, Drosophila melanogaster
RSPAVVHKKS

SEQ ID NO: 18616 - protein, 9 aa, Drosophila melanogaster
KGFEGKLRE

SEQ ID NO: 18617 - protein, 7 aa, Drosophila melanogaster
KTHKQRM

SEQ ID NO: 18618 - protein, 19 aa, Drosophila melanogaster
RGTGAGGGGVGSGGGSKRS

SEQ ID NO: 18619 - protein, 19 aa, Drosophila melanogaster
RGTGAGGGGVGSGGGSKRS

SEQ ID NO: 18620 - protein, 19 aa, Drosophila melanogaster
RGTGAGGGGVGSGGGSKRS

SEQ ID NO: 18621 - protein, 13 aa, Drosophila melanogaster
KKKPAASSGGGKQ

SEQ ID NO: 18622 - protein, 13 aa, Drosophila melanogaster
KKKPAASSGGGKQ

SEQ ID NO: 18623 - protein, 12 aa, Drosophila melanogaster
KAKHLAALEERK

SEQ ID NO: 18624 - protein, 12 aa, Drosophila melanogaster
KAKHLAALEERK

SEQ ID NO: 18625 - protein, 10 aa, Drosophila melanogaster
RKLDATIMRK

SEQ ID NO: 18626 - protein, 10 aa, Drosophila melanogaster
RKLDATIMRK

SEQ ID NO: 18627 - protein, 10 aa, Drosophila melanogaster
RKLDATIMRK

SEQ ID NO: 18628 - protein, 10 aa, Drosophila melanogaster
RKLDATIMRK

SEQ ID NO: 18629 - protein, 10 aa, Drosophila melanogaster
RKLDATIMRK

SEQ ID NO: 18630 - protein, 10 aa, Drosophila melanogaster
RKLDATIMRK

SEQ ID NO: 18631 - protein, 10 aa, Drosophila melanogaster
RKLDATIMRK

SEQ ID NO: 18632 - protein, 10 aa, Drosophila melanogaster
RKLDATIMRK

SEQ ID NO: 18633 - protein, 10 aa, Drosophila melanogaster
RKLDATIMRK

SEQ ID NO: 18634 - protein, 10 aa, Drosophila melanogaster
RKLDATIMRK

SEQ ID NO: 18635 - protein, 10 aa, Drosophila melanogaster
RKLDATIMRK

SEQ ID NO: 18636 - protein, 10 aa, Drosophila melanogaster
RKLDATIMRK

SEQ ID NO: 18637 - protein, 10 aa, Drosophila melanogaster
RKLDATIMRK

SEQ ID NO: 18638 - protein, 10 aa, Drosophila melanogaster
RKLDATIMRK

SEQ ID NO: 18639 - protein, 10 aa, Drosophila melanogaster
RKLDATIMRK

SEQ ID NO: 18640 - protein, 10 aa, Drosophila melanogaster
RKLDATIMRK

SEQ ID NO: 18641 - protein, 10 aa, Drosophila melanogaster
RKLDATIMRK

SEQ ID NO: 18642 - protein, 10 aa, Drosophila melanogaster
RKLDATIMRK

SEQ ID NO: 18643 - protein, 9 aa, Drosophila melanogaster
KGFEGKLRE

SEQ ID NO: 18644 - protein, 10 aa, Drosophila melanogaster
RKLDATIMRK

SEQ ID NO: 18645 - protein, 8 aa, Drosophila melanogaster
KKPAAMRN

SEQ ID NO: 18646 - protein, 12 aa, Drosophila melanogaster
KAKHLAALEERK

SEQ ID NO: 18647 - protein, 12 aa, Drosophila melanogaster
KAKHLAALEERK

SEQ ID NO: 18648 - protein, 12 aa, Drosophila melanogaster
KAKHLAALEERK

SEQ ID NO: 18649 - protein, 12 aa, Drosophila melanogaster
KAKHLAALEERK

SEQ ID NO: 18650 - protein, 12 aa, Drosophila melanogaster
KAKHLAALEERK

SEQ ID NO: 18651 - protein, 12 aa, Drosophila melanogaster
KAKHLAALEERK

SEQ ID NO: 18652 - protein, 12 aa, Drosophila melanogaster
KAKHLAALEERK

SEQ ID NO: 18653 - protein, 12 aa, Drosophila melanogaster
KAKHLAALEERK

SEQ ID NO: 18654 - protein, 12 aa, Drosophila melanogaster
KAKHLAALEERK

SEQ ID NO: 18655 - protein, 12 aa, Drosophila melanogaster
KAKHLAALEERK

SEQ ID NO: 18656 - protein, 12 aa, Drosophila melanogaster
KAKHLAALEERK

SEQ ID NO: 18657 - protein, 12 aa, Drosophila melanogaster
KAKHLAALEERK

SEQ ID NO: 18658 - protein, 12 aa, Drosophila melanogaster
KAKHLAALEERK

SEQ ID NO: 18659 - protein, 12 aa, Drosophila melanogaster
KAKHLAALEERK

SEQ ID NO: 18660 - protein, 12 aa, Drosophila melanogaster
KAKHLAALEERK

SEQ ID NO: 18661 - protein, 12 aa, Drosophila melanogaster
KAKHLAALEERK

SEQ ID NO: 18662 - protein, 12 aa, Drosophila melanogaster
KAKHLAALEERK

SEQ ID NO: 18663 - protein, 12 aa, Drosophila melanogaster
KAKHLAALEERK

SEQ ID NO: 18664 - protein, 12 aa, Drosophila melanogaster
KAKHLAALEERK

SEQ ID NO: 18665 - protein, 12 aa, Drosophila melanogaster
KAKHLAALEERK

SEQ ID NO: 18666 - protein, 8 aa, Drosophila melanogaster
KKPAAMRN

SEQ ID NO: 18667 - protein, 8 aa, Drosophila melanogaster
KKPAAMRN

SEQ ID NO: 18668 - protein, 8 aa, Drosophila melanogaster
KKPAAMRN

SEQ ID NO: 18669 - protein, 8 aa, Drosophila melanogaster
KKPAAMRN

SEQ ID NO: 18670 - protein, 7 aa, Drosophila melanogaster
KKLAEKI

SEQ ID NO: 18671 - protein, 14 aa, Drosophila melanogaster
RLDIQEALKRPMKQ

SEQ ID NO: 18672 - protein, 7 aa, Drosophila melanogaster
KTHKQRM

SEQ ID NO: 18673 - protein, 7 aa, Drosophila melanogaster
KTHKQRM

SEQ ID NO: 18674 - protein, 8 aa, Drosophila melanogaster
KVQQKLKT

SEQ ID NO: 18675 - protein, 9 aa, Drosophila melanogaster
RATEKLEKQ

SEQ ID NO: 18676 - protein, 12 aa, Drosophila melanogaster
RGGGSKSQHERR

SEQ ID NO: 18677 - protein, 12 aa, Drosophila melanogaster
RGGGSKSQHERR

SEQ ID NO: 18678 - protein, 19 aa, Drosophila melanogaster
RGTGAGGGGVGSGGGSKRS

SEQ ID NO: 18679 - protein, 18 aa, Drosophila melanogaster
RDLKLMTDVAGNPEEERR

SEQ ID NO: 18680 - protein, 18 aa, Drosophila melanogaster
RDLKLMTDVAGNPEEERR

SEQ ID NO: 18681 - protein, 19 aa, Drosophila melanogaster
RDLKLMTDVAGNPEEERRA

SEQ ID NO: 18682 - protein, 18 aa, Drosophila melanogaster
RDLKLMTDVAGNPEEERR

SEQ ID NO: 18683 - protein, 18 aa, Drosophila melanogaster
RDLKLMTDVAGNPEEERR

SEQ ID NO: 18684 - protein, 17 aa, Drosophila melanogaster
KIHETVDTINQMKTNRE

SEQ ID NO: 18685 - protein, 17 aa, Drosophila melanogaster
KIHETVDTINQMKTNRE

SEQ ID NO: 18686 - protein, 19 aa, Drosophila melanogaster
RGTGAGGGGVGSGGGSKRS

SEQ ID NO: 18687 - protein, 19 aa, Drosophila melanogaster
RGTGAGGGGVGSGGGSKRS

SEQ ID NO: 18688 - protein, 7 aa, Drosophila melanogaster
KVNQKRA

SEQ ID NO: 18689 - protein, 11 aa, Drosophila melanogaster
RYFFTKVNQKR

SEQ ID NO: 18690 - protein, 11 aa, Drosophila melanogaster
RYFFTKVNQKR

SEQ ID NO: 18691 - protein, 11 aa, Drosophila melanogaster
RYFFTKVNQKR

SEQ ID NO: 18692 - protein, 12 aa, Drosophila melanogaster
RGGGSKSQHERR

SEQ ID NO: 18693 - protein, 12 aa, Drosophila melanogaster
RGGGSKSQHERR

SEQ ID NO: 18694 - protein, 12 aa, Drosophila melanogaster
RGGGSKSQHERR

SEQ ID NO: 18695 - protein, 12 aa, Drosophila melanogaster
RGGGSKSQHERR

SEQ ID NO: 18696 - protein, 12 aa, Drosophila melanogaster
RGGGSKSQHERR

SEQ ID NO: 18697 - protein, 12 aa, Drosophila melanogaster
RGGGSKSQHERR

SEQ ID NO: 18698 - protein, 12 aa, Drosophila melanogaster
RGGGSKSQHERR

SEQ ID NO: 18699 - protein, 10 aa, Drosophila melanogaster
RKLDATIMRK

SEQ ID NO: 18700 - protein, 10 aa, Drosophila melanogaster
RKLDATIMRK

SEQ ID NO: 18701 - protein, 12 aa, Drosophila melanogaster
RGGGSKSQHERR

SEQ ID NO: 18702 - protein, 12 aa, Drosophila melanogaster
RGGGSKSQHERR

SEQ ID NO: 18703 - protein, 9 aa, Drosophila melanogaster
KILPQKVRD

SEQ ID NO: 18704 - protein, 9 aa, Drosophila melanogaster
KAKHPELKL

SEQ ID NO: 18705 - protein, 9 aa, Drosophila melanogaster
KKLEIKLRH

SEQ ID NO: 18706 - protein, 9 aa, Drosophila melanogaster
KKLEIKLRH

SEQ ID NO: 18707 - protein, 9 aa, Drosophila melanogaster
KKLEIKLRH

SEQ ID NO: 18708 - protein, 9 aa, Drosophila melanogaster
KKLEIKLRH

SEQ ID NO: 18709 - protein, 7 aa, Drosophila melanogaster
KKLEIKL

SEQ ID NO: 18710 - protein, 7 aa, Drosophila melanogaster
KKLEIKL

SEQ ID NO: 18711 - protein, 7 aa, Drosophila melanogaster
KFEAKKQ

SEQ ID NO: 18712 - protein, 7 aa, Drosophila melanogaster
KFEAKKQ

SEQ ID NO: 18713 - protein, 7 aa, Drosophila melanogaster
KFEAKKQ

SEQ ID NO: 18714 - protein, 12 aa, Drosophila melanogaster
RGGGSKSQHERR

SEQ ID NO: 18715 - protein, 12 aa, Drosophila melanogaster
RGGGSKSQHERR

SEQ ID NO: 18716 - protein, 12 aa, Drosophila melanogaster
KNVEKASAGGKF

SEQ ID NO: 18717 - protein, 15 aa, Drosophila melanogaster
RHCKPAVDEETFQKM

SEQ ID NO: 18718 - protein, 15 aa, Drosophila melanogaster
RHCKPAVDEETFQKM

SEQ ID NO: 18719 - protein, 15 aa, Drosophila melanogaster
RHCKPAVDEETFQKM

SEQ ID NO: 18720 - protein, 15 aa, Drosophila melanogaster
RHCKPAVDEETFQKM

SEQ ID NO: 18721 - protein, 7 aa, Drosophila melanogaster
DLITKAK

SEQ ID NO: 18722 - protein, 14 aa, Drosophila melanogaster
KAMGMSYAGLPPPR

SEQ ID NO: 18723 - protein, 14 aa, Drosophila melanogaster
KAMGMSYAGLPPPR

SEQ ID NO: 18724 - protein, 14 aa, Drosophila melanogaster
KAMGMSYAGLPPPR

SEQ ID NO: 18725 - protein, 14 aa, Drosophila melanogaster
KAMGMSYAGLPPPR

SEQ ID NO: 18726 - protein, 14 aa, Drosophila melanogaster
KAMGMSYAGLPPPR

SEQ ID NO: 18727 - protein, 14 aa, Drosophila melanogaster
KAMGMSYAGLPPPR

SEQ ID NO: 18728 - protein, 14 aa, Drosophila melanogaster
KAMGMSYAGLPPPR

SEQ ID NO: 18729 - protein, 14 aa, Drosophila melanogaster
KAMGMSYAGLPPPR

SEQ ID NO: 18730 - protein, 14 aa, Drosophila melanogaster
KAMGMSYAGLPPPR

SEQ ID NO: 18731 - protein, 14 aa, Drosophila melanogaster
KAMGMSYAGLPPPR

SEQ ID NO: 18732 - protein, 14 aa, Drosophila melanogaster
KAMGMSYAGLPPPR

SEQ ID NO: 18733 - protein, 14 aa, Drosophila melanogaster
KAMGMSYAGLPPPR

SEQ ID NO: 18734 - protein, 14 aa, Drosophila melanogaster
KAMGMSYAGLPPPR

SEQ ID NO: 18735 - protein, 14 aa, Drosophila melanogaster
KAMGMSYAGLPPPR

SEQ ID NO: 18736 - protein, 12 aa, Drosophila melanogaster
LKMISANGSVER

SEQ ID NO: 18737 - protein, 12 aa, Drosophila melanogaster
LKMISANGSVER

SEQ ID NO: 18738 - protein, 4 aa, Drosophila melanogaster
NKSK

SEQ ID NO: 18739 - protein, 7 aa, Drosophila melanogaster
DALKMLK

SEQ ID NO: 18740 - protein, 7 aa, Drosophila melanogaster
DLITKAK

SEQ ID NO: 18741 - protein, 7 aa, Drosophila melanogaster
DLITKAK

SEQ ID NO: 18742 - protein, 4 aa, Drosophila melanogaster
EQKK

SEQ ID NO: 18743 - protein, 5 aa, Drosophila melanogaster
VHTKK

SEQ ID NO: 18744 - protein, 7 aa, Drosophila melanogaster
KIRDQDR

SEQ ID NO: 18745 - protein, 7 aa, Drosophila melanogaster
KIRDQDR

SEQ ID NO: 18746 - protein, 7 aa, Drosophila melanogaster
KIRDQDR

SEQ ID NO: 18747 - protein, 8 aa, Drosophila melanogaster
KLDATIMR

SEQ ID NO: 18748 - protein, 15 aa, Drosophila melanogaster
KIKSLVALLVETQMK

SEQ ID NO: 18749 - protein, 15 aa, Drosophila melanogaster
KIKSLVALLVETQMK

SEQ ID NO: 18750 - protein, 15 aa, Drosophila melanogaster
KIKSLVALLVETQMK

SEQ ID NO: 18751 - protein, 6 aa, Drosophila melanogaster
KPAAMR

SEQ ID NO: 18752 - protein, 10 aa, Drosophila melanogaster
THKLQDAHER

SEQ ID NO: 18753 - protein, 10 aa, Drosophila melanogaster
THKLQDAHER

SEQ ID NO: 18754 - protein, 10 aa, Drosophila melanogaster
THKLQDAHER

SEQ ID NO: 18755 - protein, 10 aa, Drosophila melanogaster
THKLQDAHER

SEQ ID NO: 18756 - protein, 10 aa, Drosophila melanogaster
THKLQDAHER

SEQ ID NO: 18757 - protein, 10 aa, Drosophila melanogaster
THKLQDAHER

SEQ ID NO: 18758 - protein, 10 aa, Drosophila melanogaster
THKLQDAHER

SEQ ID NO: 18759 - protein, 10 aa, Drosophila melanogaster
THKLQDAHER

SEQ ID NO: 18760 - protein, 10 aa, Drosophila melanogaster
THKLQDAHER

SEQ ID NO: 18761 - protein, 10 aa, Drosophila melanogaster
THKLQDAHER

SEQ ID NO: 18762 - protein, 10 aa, Drosophila melanogaster
THKLQDAHER

SEQ ID NO: 18763 - protein, 10 aa, Drosophila melanogaster
THKLQDAHER

SEQ ID NO: 18764 - protein, 10 aa, Drosophila melanogaster
THKLQDAHER

SEQ ID NO: 18765 - protein, 10 aa, Drosophila melanogaster
THKLQDAHER

SEQ ID NO: 18766 - protein, 10 aa, Drosophila melanogaster
THKLQDAHER

SEQ ID NO: 18767 - protein, 10 aa, Drosophila melanogaster
THKLQDAHER

SEQ ID NO: 18768 - protein, 10 aa, Drosophila melanogaster
THKLQDAHER

SEQ ID NO: 18769 - protein, 10 aa, Drosophila melanogaster
THKLQDAHER

SEQ ID NO: 18770 - protein, 10 aa, Drosophila melanogaster
THKLQDAHER

SEQ ID NO: 18771 - protein, 10 aa, Drosophila melanogaster
THKLQDAHER

SEQ ID NO: 18772 - protein, 18 aa, Drosophila melanogaster
ANAALQSTASPAPGGKSR

SEQ ID NO: 18773 - protein, 18 aa, Drosophila melanogaster
ANAALQSTASPAPGGKSR

SEQ ID NO: 18774 - protein, 18 aa, Drosophila melanogaster
ANAALQSTASPAPGGKSR

SEQ ID NO: 18775 - protein, 7 aa, Drosophila melanogaster
ILPQKVR

SEQ ID NO: 18776 - protein, 7 aa, Drosophila melanogaster
ILPQKVR

SEQ ID NO: 18777 - protein, 7 aa, Drosophila melanogaster
ILPQKVR

SEQ ID NO: 18778 - protein, 7 aa, Drosophila melanogaster
ILPQKVR

SEQ ID NO: 18779 - protein, 7 aa, Drosophila melanogaster
ILPQKVR

SEQ ID NO: 18780 - protein, 6 aa, Drosophila melanogaster
KPAAMR

SEQ ID NO: 18781 - protein, 9 aa, Drosophila melanogaster
MKFAEIPQR

SEQ ID NO: 18782 - protein, 9 aa, Drosophila melanogaster
MKFAEIPQR

SEQ ID NO: 18783 - protein, 9 aa, Drosophila melanogaster
MKFAEIPQR

SEQ ID NO: 18784 - protein, 9 aa, Drosophila melanogaster
MKFAEIPQR

SEQ ID NO: 18785 - protein, 9 aa, Drosophila melanogaster
MKFAEIPQR

SEQ ID NO: 18786 - protein, 7 aa, Drosophila melanogaster
GFEGKLR

SEQ ID NO: 18787 - protein, 7 aa, Drosophila melanogaster
KLEIKLR

SEQ ID NO: 18788 - protein, 5 aa, Drosophila melanogaster
VNQKR

SEQ ID NO: 18789 - protein, 5 aa, Drosophila melanogaster
VNQKR

SEQ ID NO: 18790 - protein, 4 aa, Drosophila melanogaster
NKSK

SEQ ID NO: 18791 - protein, 12 aa, Drosophila melanogaster
TLLDLDKKPLGK

SEQ ID NO: 18792 - protein, 6 aa, Drosophila melanogaster
KPAAMR

SEQ ID NO: 18793 - protein, 12 aa, Drosophila melanogaster
LLEDGKGDPNTK

SEQ ID NO: 18794 - protein, 5 aa, Drosophila melanogaster
THKQR

SEQ ID NO: 18795 - protein, 14 aa, Drosophila melanogaster
QQFHLEQLKAAEFR

SEQ ID NO: 18796 - protein, 9 aa, Drosophila melanogaster
YFFTKVNQK

SEQ ID NO: 18797 - protein, 10 aa, Drosophila melanogaster
AKHLAALEER

SEQ ID NO: 18798 - protein, 10 aa, Drosophila melanogaster
AKHLAALEER

SEQ ID NO: 18799 - protein, 17 aa, Drosophila melanogaster
GTGAGGGGVGSGGGSKR

SEQ ID NO: 18800 - protein, 17 aa, Drosophila melanogaster
GTGAGGGGVGSGGGSKR

SEQ ID NO: 18801 - protein, 17 aa, Drosophila melanogaster
GTGAGGGGVGSGGGSKR

SEQ ID NO: 18802 - protein, 17 aa, Drosophila melanogaster
GTGAGGGGVGSGGGSKR

SEQ ID NO: 18803 - protein, 4 aa, Drosophila melanogaster
KTHK

SEQ ID NO: 18804 - protein, 8 aa, Drosophila melanogaster
SPAVVHKK

SEQ ID NO: 18805 - protein, 7 aa, Drosophila melanogaster
GFEGKLR

SEQ ID NO: 18806 - protein, 5 aa, Drosophila melanogaster
THKQR

SEQ ID NO: 18807 - protein, 17 aa, Drosophila melanogaster
GTGAGGGGVGSGGGSKR

SEQ ID NO: 18808 - protein, 17 aa, Drosophila melanogaster
GTGAGGGGVGSGGGSKR

SEQ ID NO: 18809 - protein, 17 aa, Drosophila melanogaster
GTGAGGGGVGSGGGSKR

SEQ ID NO: 18810 - protein, 11 aa, Drosophila melanogaster
KKPAASSGGGK

SEQ ID NO: 18811 - protein, 11 aa, Drosophila melanogaster
KKPAASSGGGK

SEQ ID NO: 18812 - protein, 10 aa, Drosophila melanogaster
AKHLAALEER

SEQ ID NO: 18813 - protein, 10 aa, Drosophila melanogaster
AKHLAALEER

SEQ ID NO: 18814 - protein, 8 aa, Drosophila melanogaster
KLDATIMR

SEQ ID NO: 18815 - protein, 8 aa, Drosophila melanogaster
KLDATIMR

SEQ ID NO: 18816 - protein, 8 aa, Drosophila melanogaster
KLDATIMR

SEQ ID NO: 18817 - protein, 8 aa, Drosophila melanogaster
KLDATIMR

SEQ ID NO: 18818 - protein, 8 aa, Drosophila melanogaster
KLDATIMR

SEQ ID NO: 18819 - protein, 8 aa, Drosophila melanogaster
KLDATIMR

SEQ ID NO: 18820 - protein, 8 aa, Drosophila melanogaster
KLDATIMR

SEQ ID NO: 18821 - protein, 8 aa, Drosophila melanogaster
KLDATIMR

SEQ ID NO: 18822 - protein, 8 aa, Drosophila melanogaster
KLDATIMR

SEQ ID NO: 18823 - protein, 8 aa, Drosophila melanogaster
KLDATIMR

SEQ ID NO: 18824 - protein, 8 aa, Drosophila melanogaster
KLDATIMR

SEQ ID NO: 18825 - protein, 8 aa, Drosophila melanogaster
KLDATIMR

SEQ ID NO: 18826 - protein, 8 aa, Drosophila melanogaster
KLDATIMR

SEQ ID NO: 18827 - protein, 8 aa, Drosophila melanogaster
KLDATIMR

SEQ ID NO: 18828 - protein, 8 aa, Drosophila melanogaster
KLDATIMR

SEQ ID NO: 18829 - protein, 8 aa, Drosophila melanogaster
KLDATIMR

SEQ ID NO: 18830 - protein, 8 aa, Drosophila melanogaster
KLDATIMR

SEQ ID NO: 18831 - protein, 8 aa, Drosophila melanogaster
KLDATIMR

SEQ ID NO: 18832 - protein, 7 aa, Drosophila melanogaster
GFEGKLR

SEQ ID NO: 18833 - protein, 8 aa, Drosophila melanogaster
KLDATIMR

SEQ ID NO: 18834 - protein, 6 aa, Drosophila melanogaster
KPAAMR

SEQ ID NO: 18835 - protein, 10 aa, Drosophila melanogaster
AKHLAALEER

SEQ ID NO: 18836 - protein, 10 aa, Drosophila melanogaster
AKHLAALEER

SEQ ID NO: 18837 - protein, 10 aa, Drosophila melanogaster
AKHLAALEER

SEQ ID NO: 18838 - protein, 10 aa, Drosophila melanogaster
AKHLAALEER

SEQ ID NO: 18839 - protein, 10 aa, Drosophila melanogaster
AKHLAALEER

SEQ ID NO: 18840 - protein, 10 aa, Drosophila melanogaster
AKHLAALEER

SEQ ID NO: 18841 - protein, 10 aa, Drosophila melanogaster
AKHLAALEER

SEQ ID NO: 18842 - protein, 10 aa, Drosophila melanogaster
AKHLAALEER

SEQ ID NO: 18843 - protein, 10 aa, Drosophila melanogaster
AKHLAALEER

SEQ ID NO: 18844 - protein, 10 aa, Drosophila melanogaster
AKHLAALEER

SEQ ID NO: 18845 - protein, 10 aa, Drosophila melanogaster
AKHLAALEER

SEQ ID NO: 18846 - protein, 10 aa, Drosophila melanogaster
AKHLAALEER

SEQ ID NO: 18847 - protein, 10 aa, Drosophila melanogaster
AKHLAALEER

SEQ ID NO: 18848 - protein, 10 aa, Drosophila melanogaster
AKHLAALEER

SEQ ID NO: 18849 - protein, 10 aa, Drosophila melanogaster
AKHLAALEER

SEQ ID NO: 18850 - protein, 10 aa, Drosophila melanogaster
AKHLAALEER

SEQ ID NO: 18851 - protein, 10 aa, Drosophila melanogaster
AKHLAALEER

SEQ ID NO: 18852 - protein, 10 aa, Drosophila melanogaster
AKHLAALEER

SEQ ID NO: 18853 - protein, 10 aa, Drosophila melanogaster
AKHLAALEER

SEQ ID NO: 18854 - protein, 10 aa, Drosophila melanogaster
AKHLAALEER

SEQ ID NO: 18855 - protein, 6 aa, Drosophila melanogaster
KPAAMR

SEQ ID NO: 18856 - protein, 6 aa, Drosophila melanogaster
KPAAMR

SEQ ID NO: 18857 - protein, 6 aa, Drosophila melanogaster
KPAAMR

SEQ ID NO: 18858 - protein, 6 aa, Drosophila melanogaster
KPAAMR

SEQ ID NO: 18859 - protein, 5 aa, Drosophila melanogaster
KLAEK

SEQ ID NO: 18860 - protein, 12 aa, Drosophila melanogaster
LDIQEALKRPMK

SEQ ID NO: 18861 - protein, 5 aa, Drosophila melanogaster
THKQR

SEQ ID NO: 18862 - protein, 5 aa, Drosophila melanogaster
THKQR

SEQ ID NO: 18863 - protein, 6 aa, Drosophila melanogaster
VQQKLK

SEQ ID NO: 18864 - protein, 7 aa, Drosophila melanogaster
ATEKLEK

SEQ ID NO: 18865 - protein, 10 aa, Drosophila melanogaster
GGGSKSQHER

SEQ ID NO: 18866 - protein, 10 aa, Drosophila melanogaster
GGGSKSQHER

SEQ ID NO: 18867 - protein, 17 aa, Drosophila melanogaster
GTGAGGGGVGSGGGSKR

SEQ ID NO: 18868 - protein, 16 aa, Drosophila melanogaster
DLKLMTDVAGNPEEER

SEQ ID NO: 18869 - protein, 16 aa, Drosophila melanogaster
DLKLMTDVAGNPEEER

SEQ ID NO: 18870 - protein, 17 aa, Drosophila melanogaster
DLKLMTDVAGNPEEERR

SEQ ID NO: 18871 - protein, 16 aa, Drosophila melanogaster
DLKLMTDVAGNPEEER

SEQ ID NO: 18872 - protein, 16 aa, Drosophila melanogaster
DLKLMTDVAGNPEEER

SEQ ID NO: 18873 - protein, 15 aa, Drosophila melanogaster
IHETVDTINQMKTNR

SEQ ID NO: 18874 - protein, 15 aa, Drosophila melanogaster
IHETVDTINQMKTNR

SEQ ID NO: 18875 - protein, 17 aa, Drosophila melanogaster
GTGAGGGGVGSGGGSKR

SEQ ID NO: 18876 - protein, 17 aa, Drosophila melanogaster
GTGAGGGGVGSGGGSKR

SEQ ID NO: 18877 - protein, 5 aa, Drosophila melanogaster
VNQKR

SEQ ID NO: 18878 - protein, 9 aa, Drosophila melanogaster
YFFTKVNQK

SEQ ID NO: 18879 - protein, 9 aa, Drosophila melanogaster
YFFTKVNQK

SEQ ID NO: 18880 - protein, 9 aa, Drosophila melanogaster
YFFTKVNQK

SEQ ID NO: 18881 - protein, 10 aa, Drosophila melanogaster
GGGSKSQHER

SEQ ID NO: 18882 - protein, 10 aa, Drosophila melanogaster
GGGSKSQHER

SEQ ID NO: 18883 - protein, 10 aa, Drosophila melanogaster
GGGSKSQHER

SEQ ID NO: 18884 - protein, 10 aa, Drosophila melanogaster
GGGSKSQHER

SEQ ID NO: 18885 - protein, 10 aa, Drosophila melanogaster
GGGSKSQHER

SEQ ID NO: 18886 - protein, 10 aa, Drosophila melanogaster
GGGSKSQHER

SEQ ID NO: 18887 - protein, 10 aa, Drosophila melanogaster
GGGSKSQHER

SEQ ID NO: 18888 - protein, 8 aa, Drosophila melanogaster
KLDATIMR

SEQ ID NO: 18889 - protein, 8 aa, Drosophila melanogaster
KLDATIMR

SEQ ID NO: 18890 - protein, 10 aa, Drosophila melanogaster
GGGSKSQHER

SEQ ID NO: 18891 - protein, 10 aa, Drosophila melanogaster
GGGSKSQHER

SEQ ID NO: 18892 - protein, 7 aa, Drosophila melanogaster
ILPQKVR

SEQ ID NO: 18893 - protein, 7 aa, Drosophila melanogaster
AKHPELK

SEQ ID NO: 18894 - protein, 7 aa, Drosophila melanogaster
KLEIKLR

SEQ ID NO: 18895 - protein, 7 aa, Drosophila melanogaster
KLEIKLR

SEQ ID NO: 18896 - protein, 7 aa, Drosophila melanogaster
KLEIKLR

SEQ ID NO: 18897 - protein, 7 aa, Drosophila melanogaster
KLEIKLR

SEQ ID NO: 18898 - protein, 5 aa, Drosophila melanogaster
KLEIK

SEQ ID NO: 18899 - protein, 5 aa, Drosophila melanogaster
KLEIK

SEQ ID NO: 18900 - protein, 5 aa, Drosophila melanogaster
FEAKK

SEQ ID NO: 18901 - protein, 5 aa, Drosophila melanogaster
FEAKK

SEQ ID NO: 18902 - protein, 5 aa, Drosophila melanogaster
FEAKK

SEQ ID NO: 18903 - protein, 10 aa, Drosophila melanogaster
GGGSKSQHER

SEQ ID NO: 18904 - protein, 10 aa, Drosophila melanogaster
GGGSKSQHER

SEQ ID NO: 18905 - protein, 10 aa, Drosophila melanogaster
NVEKASAGGK

SEQ ID NO: 18906 - protein, 13 aa, Drosophila melanogaster
HCKPAVDEETFQK

SEQ ID NO: 18907 - protein, 13 aa, Drosophila melanogaster
HCKPAVDEETFQK

SEQ ID NO: 18908 - protein, 13 aa, Drosophila melanogaster
HCKPAVDEETFQK

SEQ ID NO: 18909 - protein, 13 aa, Drosophila melanogaster
HCKPAVDEETFQK

SEQ ID NO: 18910 - protein, 6 aa, Drosophila melanogaster
RYSKRV

SEQ ID NO: 18911 - protein, 15 aa, Drosophila melanogaster
RHCKPAVDEETFQKM

SEQ ID NO: 18912 - protein, 15 aa, Drosophila melanogaster
RHCKPAVDEETFQKM

SEQ ID NO: 18913 - protein, 15 aa, Drosophila melanogaster
RHCKPAVDEETFQKM

SEQ ID NO: 18914 - protein, 15 aa, Drosophila melanogaster
RHCKPAVDEETFQKM

SEQ ID NO: 18915 - protein, 15 aa, Drosophila melanogaster
RHCKPAVDEETFQKM

SEQ ID NO: 18916 - protein, 16 aa, Drosophila melanogaster
RMVESSEAFQEELKRH

SEQ ID NO: 18917 - protein, 15 aa, Drosophila melanogaster
RHCKPAVDEETFQKM

SEQ ID NO: 18918 - protein, 15 aa, Drosophila melanogaster
RHCKPAVDEETFQKM

SEQ ID NO: 18919 - protein, 16 aa, Drosophila melanogaster
RMVESSEAFQEELKRH

SEQ ID NO: 18920 - protein, 15 aa, Drosophila melanogaster
RHCKPAVDEETFQKM

SEQ ID NO: 18921 - protein, 13 aa, Drosophila melanogaster
KSSSSKNQNESRL

SEQ ID NO: 18922 - protein, 13 aa, Drosophila melanogaster
KSSSSKNQNESRL

SEQ ID NO: 18923 - protein, 13 aa, Drosophila melanogaster
KSSSSKNQNESRL

SEQ ID NO: 18924 - protein, 12 aa, Drosophila melanogaster
RGGGSKSQHERR

SEQ ID NO: 18925 - protein, 12 aa, Drosophila melanogaster
RGGGSKSQHERR

SEQ ID NO: 18926 - protein, 12 aa, Drosophila melanogaster
RGGGSKSQHERR

SEQ ID NO: 18927 - protein, 13 aa, Drosophila melanogaster
KSSSSKNQNESRL

SEQ ID NO: 18928 - protein, 13 aa, Drosophila melanogaster
KSSSSKNQNESRL

SEQ ID NO: 18929 - protein, 28 aa, Drosophila melanogaster
RRIDIQPAEDEDDQDEGYTTKHLAYARY

SEQ ID NO: 18930 - protein, 28 aa, Drosophila melanogaster
RRIDIQPAEDEDDQDEGYTTKHLAYARY

SEQ ID NO: 18931 - protein, 12 aa, Drosophila melanogaster
RGGGSKSQHERR

SEQ ID NO: 18932 - protein, 28 aa, Drosophila melanogaster
RRIDIQPAEDEDDQDEGYTTKHLAYARY

SEQ ID NO: 18933 - protein, 27 aa, Drosophila melanogaster
RNKDQTPIFTHSNYGNPAFTPQKVTKS

SEQ ID NO: 18934 - protein, 27 aa, Drosophila melanogaster
RNKDQTPIFTHSNYGNPAFTPQKVTKS

SEQ ID NO: 18935 - protein, 27 aa, Drosophila melanogaster
RNKDQTPIFTHSNYGNPAFTPQKVTKS

SEQ ID NO: 18936 - protein, 15 aa, Drosophila melanogaster
KVKTDVDMHETPSRG

SEQ ID NO: 18937 - protein, 15 aa, Drosophila melanogaster
KVKTDVDMHETPSRG

SEQ ID NO: 18938 - protein, 15 aa, Drosophila melanogaster
KVKTDVDMHETPSRG

SEQ ID NO: 18939 - protein, 15 aa, Drosophila melanogaster
KVKTDVDMHETPSRG

SEQ ID NO: 18940 - protein, 12 aa, Drosophila melanogaster
RGGGSKSQHERR

SEQ ID NO: 18941 - protein, 27 aa, Drosophila melanogaster
RNKDQTPIFTHSNYGNPAFTPQKVTKS

SEQ ID NO: 18942 - protein, 27 aa, Drosophila melanogaster
RNKDQTPIFTHSNYGNPAFTPQKVTKS

SEQ ID NO: 18943 - protein, 11 aa, Drosophila melanogaster
RMKFAEIPQRL

SEQ ID NO: 18944 - protein, 14 aa, Drosophila melanogaster
RLLEDGKGDPNTKI

SEQ ID NO: 18945 - protein, 9 aa, Drosophila melanogaster
RKFSSFFKS

SEQ ID NO: 18946 - protein, 16 aa, Drosophila melanogaster
RLLEDGKGDPNTKIKR

SEQ ID NO: 18947 - protein, 10 aa, Drosophila melanogaster
RKLDATIMRK

SEQ ID NO: 18948 - protein, 10 aa, Drosophila melanogaster
RKLDATIMRK

SEQ ID NO: 18949 - protein, 10 aa, Drosophila melanogaster
RKLDATIMRK

SEQ ID NO: 18950 - protein, 10 aa, Drosophila melanogaster
RKLDATIMRK

SEQ ID NO: 18951 - protein, 10 aa, Drosophila melanogaster
RKLDATIMRK

SEQ ID NO: 18952 - protein, 10 aa, Drosophila melanogaster
RKLDATIMRK

SEQ ID NO: 18953 - protein, 10 aa, Drosophila melanogaster
RKLDATIMRK

SEQ ID NO: 18954 - protein, 10 aa, Drosophila melanogaster
RKLDATIMRK

SEQ ID NO: 18955 - protein, 10 aa, Drosophila melanogaster
RKLDATIMRK

SEQ ID NO: 18956 - protein, 10 aa, Drosophila melanogaster
RKLDATIMRK

SEQ ID NO: 18957 - protein, 9 aa, Drosophila melanogaster
RKFSSFFKS

SEQ ID NO: 18958 - protein, 10 aa, Drosophila melanogaster
RKLDATIMRK

SEQ ID NO: 18959 - protein, 17 aa, Drosophila melanogaster
KIHETVDTINQMKTNRE

SEQ ID NO: 18960 - protein, 17 aa, Drosophila melanogaster
KIHETVDTINQMKTNRE

SEQ ID NO: 18961 - protein, 17 aa, Drosophila melanogaster
KIHETVDTINQMKTNRE

SEQ ID NO: 18962 - protein, 17 aa, Drosophila melanogaster
KIHETVDTINQMKTNRE

SEQ ID NO: 18963 - protein, 17 aa, Drosophila melanogaster
KIHETVDTINQMKTNRE

SEQ ID NO: 18964 - protein, 17 aa, Drosophila melanogaster
KIHETVDTINQMKTNRE

SEQ ID NO: 18965 - protein, 17 aa, Drosophila melanogaster
KIHETVDTINQMKTNRE

SEQ ID NO: 18966 - protein, 17 aa, Drosophila melanogaster
KIHETVDTINQMKTNRE

SEQ ID NO: 18967 - protein, 17 aa, Drosophila melanogaster
KIHETVDTINQMKTNRE

SEQ ID NO: 18968 - protein, 17 aa, Drosophila melanogaster
KIHETVDTINQMKTNRE

SEQ ID NO: 18969 - protein, 17 aa, Drosophila melanogaster
KIHETVDTINQMKTNRE

SEQ ID NO: 18970 - protein, 17 aa, Drosophila melanogaster
KIHETVDTINQMKTNRE

SEQ ID NO: 18971 - protein, 17 aa, Drosophila melanogaster
KIHETVDTINQMKTNRE

SEQ ID NO: 18972 - protein, 17 aa, Drosophila melanogaster
KIHETVDTINQMKTNRE

SEQ ID NO: 18973 - protein, 17 aa, Drosophila melanogaster
KIHETVDTINQMKTNRE

SEQ ID NO: 18974 - protein, 17 aa, Drosophila melanogaster
KIHETVDTINQMKTNRE

SEQ ID NO: 18975 - protein, 17 aa, Drosophila melanogaster
KIHETVDTINQMKTNRE

SEQ ID NO: 18976 - protein, 17 aa, Drosophila melanogaster
KIHETVDTINQMKTNRE

SEQ ID NO: 18977 - protein, 17 aa, Drosophila melanogaster
KIHETVDTINQMKTNRE

SEQ ID NO: 18978 - protein, 17 aa, Drosophila melanogaster
KIHETVDTINQMKTNRE

SEQ ID NO: 18979 - protein, 17 aa, Drosophila melanogaster
KIHETVDTINQMKTNRE

SEQ ID NO: 18980 - protein, 17 aa, Drosophila melanogaster
KIHETVDTINQMKTNRE

SEQ ID NO: 18981 - protein, 17 aa, Drosophila melanogaster
KIHETVDTINQMKTNRE

SEQ ID NO: 18982 - protein, 17 aa, Drosophila melanogaster
KIHETVDTINQMKTNRE

SEQ ID NO: 18983 - protein, 17 aa, Drosophila melanogaster
KIHETVDTINQMKTNRE

SEQ ID NO: 18984 - protein, 17 aa, Drosophila melanogaster
KIHETVDTINQMKTNRE

SEQ ID NO: 18985 - protein, 17 aa, Drosophila melanogaster
KIHETVDTINQMKTNRE

SEQ ID NO: 18986 - protein, 17 aa, Drosophila melanogaster
KIHETVDTINQMKTNRE

SEQ ID NO: 18987 - protein, 17 aa, Drosophila melanogaster
KIHETVDTINQMKTNRE

SEQ ID NO: 18988 - protein, 17 aa, Drosophila melanogaster
KIHETVDTINQMKTNRE

SEQ ID NO: 18989 - protein, 17 aa, Drosophila melanogaster
KIHETVDTINQMKTNRE

SEQ ID NO: 18990 - protein, 17 aa, Drosophila melanogaster
KIHETVDTINQMKTNRE

SEQ ID NO: 18991 - protein, 17 aa, Drosophila melanogaster
KIHETVDTINQMKTNRE

SEQ ID NO: 18992 - protein, 17 aa, Drosophila melanogaster
KIHETVDTINQMKTNRE

SEQ ID NO: 18993 - protein, 17 aa, Drosophila melanogaster
KIHETVDTINQMKTNRE

SEQ ID NO: 18994 - protein, 17 aa, Drosophila melanogaster
KIHETVDTINQMKTNRE

SEQ ID NO: 18995 - protein, 17 aa, Drosophila melanogaster
KIHETVDTINQMKTNRE

SEQ ID NO: 18996 - protein, 17 aa, Drosophila melanogaster
KIHETVDTINQMKTNRE

SEQ ID NO: 18997 - protein, 17 aa, Drosophila melanogaster
KIHETVDTINQMKTNRE

SEQ ID NO: 18998 - protein, 17 aa, Drosophila melanogaster
KIHETVDTINQMKTNRE

SEQ ID NO: 18999 - protein, 17 aa, Drosophila melanogaster
KIHETVDTINQMKTNRE

SEQ ID NO: 19000 - protein, 17 aa, Drosophila melanogaster
KIHETVDTINQMKTNRE

SEQ ID NO: 19001 - protein, 17 aa, Drosophila melanogaster
KIHETVDTINQMKTNRE

SEQ ID NO: 19002 - protein, 17 aa, Drosophila melanogaster
KIHETVDTINQMKTNRE

SEQ ID NO: 19003 - protein, 17 aa, Drosophila melanogaster
KIHETVDTINQMKTNRE

SEQ ID NO: 19004 - protein, 17 aa, Drosophila melanogaster
KIHETVDTINQMKTNRE

SEQ ID NO: 19005 - protein, 17 aa, Drosophila melanogaster
KIHETVDTINQMKTNRE

SEQ ID NO: 19006 - protein, 17 aa, Drosophila melanogaster
KIHETVDTINQMKTNRE

SEQ ID NO: 19007 - protein, 17 aa, Drosophila melanogaster
KIHETVDTINQMKTNRE

SEQ ID NO: 19008 - protein, 17 aa, Drosophila melanogaster
KIHETVDTINQMKTNRE

SEQ ID NO: 19009 - protein, 17 aa, Drosophila melanogaster
KIHETVDTINQMKTNRE

SEQ ID NO: 19010 - protein, 17 aa, Drosophila melanogaster
KIHETVDTINQMKTNRE

SEQ ID NO: 19011 - protein, 17 aa, Drosophila melanogaster
KIHETVDTINQMKTNRE

SEQ ID NO: 19012 - protein, 17 aa, Drosophila melanogaster
KIHETVDTINQMKTNRE

SEQ ID NO: 19013 - protein, 17 aa, Drosophila melanogaster
KIHETVDTINQMKTNRE

SEQ ID NO: 19014 - protein, 17 aa, Drosophila melanogaster
KIHETVDTINQMKTNRE

SEQ ID NO: 19015 - protein, 17 aa, Drosophila melanogaster
KIHETVDTINQMKTNRE

SEQ ID NO: 19016 - protein, 17 aa, Drosophila melanogaster
KIHETVDTINQMKTNRE

SEQ ID NO: 19017 - protein, 17 aa, Drosophila melanogaster
KIHETVDTINQMKTNRE

SEQ ID NO: 19018 - protein, 17 aa, Drosophila melanogaster
KIHETVDTINQMKTNRE

SEQ ID NO: 19019 - protein, 17 aa, Drosophila melanogaster
KIHETVDTINQMKTNRE

SEQ ID NO: 19020 - protein, 17 aa, Drosophila melanogaster
KIHETVDTINQMKTNRE

SEQ ID NO: 19021 - protein, 17 aa, Drosophila melanogaster
KIHETVDTINQMKTNRE

SEQ ID NO: 19022 - protein, 17 aa, Drosophila melanogaster
KIHETVDTINQMKTNRE

SEQ ID NO: 19023 - protein, 17 aa, Drosophila melanogaster
KIHETVDTINQMKTNRE

SEQ ID NO: 19024 - protein, 17 aa, Drosophila melanogaster
KIHETVDTINQMKTNRE

SEQ ID NO: 19025 - protein, 17 aa, Drosophila melanogaster
KIHETVDTINQMKTNRE

SEQ ID NO: 19026 - protein, 17 aa, Drosophila melanogaster
KIHETVDTINQMKTNRE

SEQ ID NO: 19027 - protein, 17 aa, Drosophila melanogaster
KIHETVDTINQMKTNRE

SEQ ID NO: 19028 - protein, 17 aa, Drosophila melanogaster
KIHETVDTINQMKTNRE

SEQ ID NO: 19029 - protein, 17 aa, Drosophila melanogaster
KIHETVDTINQMKTNRE

SEQ ID NO: 19030 - protein, 17 aa, Drosophila melanogaster
KIHETVDTINQMKTNRE

SEQ ID NO: 19031 - protein, 17 aa, Drosophila melanogaster
KIHETVDTINQMKTNRE

SEQ ID NO: 19032 - protein, 17 aa, Drosophila melanogaster
KIHETVDTINQMKTNRE

SEQ ID NO: 19033 - protein, 11 aa, Drosophila melanogaster
RYFFTKVNQKR

SEQ ID NO: 19034 - protein, 11 aa, Drosophila melanogaster
RYFFTKVNQKR

SEQ ID NO: 19035 - protein, 11 aa, Drosophila melanogaster
RYFFTKVNQKR

SEQ ID NO: 19036 - protein, 11 aa, Drosophila melanogaster
RYFFTKVNQKR

SEQ ID NO: 19037 - protein, 17 aa, Drosophila melanogaster
KIHETVDTINQMKTNRE

SEQ ID NO: 19038 - protein, 16 aa, Drosophila melanogaster
RLLEDGKGDPNTKIKR

SEQ ID NO: 19039 - protein, 16 aa, Drosophila melanogaster
RLLEDGKGDPNTKIKR

SEQ ID NO: 19040 - protein, 9 aa, Drosophila melanogaster
RKFSSFFKS

SEQ ID NO: 19041 - protein, 16 aa, Drosophila melanogaster
RLLEDGKGDPNTKIKR

SEQ ID NO: 19042 - protein, 16 aa, Drosophila melanogaster
RLLEDGKGDPNTKIKR

SEQ ID NO: 19043 - protein, 16 aa, Drosophila melanogaster
RLLEDGKGDPNTKIKR

SEQ ID NO: 19044 - protein, 9 aa, Drosophila melanogaster
RKFSSFFKS

SEQ ID NO: 19045 - protein, 16 aa, Drosophila melanogaster
RLLEDGKGDPNTKIKR

SEQ ID NO: 19046 - protein, 16 aa, Drosophila melanogaster
RLLEDGKGDPNTKIKR

SEQ ID NO: 19047 - protein, 16 aa, Drosophila melanogaster
RLLEDGKGDPNTKIKR

SEQ ID NO: 19048 - protein, 11 aa, Drosophila melanogaster
KGDPNTKIKRK

SEQ ID NO: 19049 - protein, 11 aa, Drosophila melanogaster
RMKFAEIPQRL

SEQ ID NO: 19050 - protein, 11 aa, Drosophila melanogaster
RMKFAEIPQRL

SEQ ID NO: 19051 - protein, 11 aa, Drosophila melanogaster
RMKFAEIPQRL

SEQ ID NO: 19052 - protein, 11 aa, Drosophila melanogaster
RMKFAEIPQRL

SEQ ID NO: 19053 - protein, 11 aa, Drosophila melanogaster
RMKFAEIPQRL

SEQ ID NO: 19054 - protein, 11 aa, Drosophila melanogaster
RMKFAEIPQRL

SEQ ID NO: 19055 - protein, 11 aa, Drosophila melanogaster
RMKFAEIPQRL

SEQ ID NO: 19056 - protein, 11 aa, Drosophila melanogaster
RMKFAEIPQRL

SEQ ID NO: 19057 - protein, 11 aa, Drosophila melanogaster
RMKFAEIPQRL

SEQ ID NO: 19058 - protein, 11 aa, Drosophila melanogaster
RMKFAEIPQRL

SEQ ID NO: 19059 - protein, 11 aa, Drosophila melanogaster
RYFFTKVNQKR

SEQ ID NO: 19060 - protein, 11 aa, Drosophila melanogaster
RYFFTKVNQKR

SEQ ID NO: 19061 - protein, 11 aa, Drosophila melanogaster
RYFFTKVNQKR

SEQ ID NO: 19062 - protein, 11 aa, Drosophila melanogaster
RYFFTKVNQKR

SEQ ID NO: 19063 - protein, 18 aa, Drosophila melanogaster
RDLKLMTDVAGNPEEERR

SEQ ID NO: 19064 - protein, 11 aa, Drosophila melanogaster
RYFFTKVNQKR

SEQ ID NO: 19065 - protein, 19 aa, Drosophila melanogaster
RGTGAGGGGVGSGGGSKRS

SEQ ID NO: 19066 - protein, 20 aa, Drosophila melanogaster
RTHTTQETDGFQVKRPGDRN

SEQ ID NO: 19067 - protein, 20 aa, Drosophila melanogaster
RTHTTQETDGFQVKRPGDRN

SEQ ID NO: 19068 - protein, 20 aa, Drosophila melanogaster
RTHTTQETDGFQVKRPGDRN

SEQ ID NO: 19069 - protein, 19 aa, Drosophila melanogaster
RGTGAGGGGVGSGGGSKRS

SEQ ID NO: 19070 - protein, 10 aa, Drosophila melanogaster
RKLDATIMRK

SEQ ID NO: 19071 - protein, 10 aa, Drosophila melanogaster
RKLDATIMRK

SEQ ID NO: 19072 - protein, 19 aa, Drosophila melanogaster
RGTGAGGGGVGSGGGSKRS

SEQ ID NO: 19073 - protein, 19 aa, Drosophila melanogaster
RGTGAGGGGVGSGGGSKRS

SEQ ID NO: 19074 - protein, 19 aa, Drosophila melanogaster
RGTGAGGGGVGSGGGSKRS

SEQ ID NO: 19075 - protein, 17 aa, Drosophila melanogaster
KIHETVDTINQMKTNRE

SEQ ID NO: 19076 - protein, 19 aa, Drosophila melanogaster
RGTGAGGGGVGSGGGSKRS

SEQ ID NO: 19077 - protein, 19 aa, Drosophila melanogaster
RGTGAGGGGVGSGGGSKRS

SEQ ID NO: 19078 - protein, 19 aa, Drosophila melanogaster
RGTGAGGGGVGSGGGSKRS

SEQ ID NO: 19079 - protein, 17 aa, Drosophila melanogaster
KIHETVDTINQMKTNRE

SEQ ID NO: 19080 - protein, 19 aa, Drosophila melanogaster
RGTGAGGGGVGSGGGSKRS

SEQ ID NO: 19081 - protein, 19 aa, Drosophila melanogaster
RGTGAGGGGVGSGGGSKRS

SEQ ID NO: 19082 - protein, 11 aa, Drosophila melanogaster
RMKFAEIPQRL

SEQ ID NO: 19083 - protein, 19 aa, Drosophila melanogaster
RGTGAGGGGVGSGGGSKRS

SEQ ID NO: 19084 - protein, 19 aa, Drosophila melanogaster
RGTGAGGGGVGSGGGSKRS

SEQ ID NO: 19085 - protein, 19 aa, Drosophila melanogaster
RGTGAGGGGVGSGGGSKRS

SEQ ID NO: 19086 - protein, 11 aa, Drosophila melanogaster
RMKFAEIPQRL

SEQ ID NO: 19087 - protein, 11 aa, Drosophila melanogaster
RMKFAEIPQRL

SEQ ID NO: 19088 - protein, 11 aa, Drosophila melanogaster
RMKFAEIPQRL

SEQ ID NO: 19089 - protein, 17 aa, Drosophila melanogaster
RSLGGGGSKSDFATAKK

SEQ ID NO: 19090 - protein, 17 aa, Drosophila melanogaster
RSLGGGGSKSDFATAKK

SEQ ID NO: 19091 - protein, 17 aa, Drosophila melanogaster
RSLGGGGSKSDFATAKK

SEQ ID NO: 19092 - protein, 10 aa, Drosophila melanogaster
KSDFATAKKK

SEQ ID NO: 19093 - protein, 19 aa, Drosophila melanogaster
RGTGAGGGGVGSGGGSKRS

SEQ ID NO: 19094 - protein, 19 aa, Drosophila melanogaster
RGTGAGGGGVGSGGGSKRS

SEQ ID NO: 19095 - protein, 19 aa, Drosophila melanogaster
RGTGAGGGGVGSGGGSKRS

SEQ ID NO: 19096 - protein, 19 aa, Drosophila melanogaster
RGTGAGGGGVGSGGGSKRS

SEQ ID NO: 19097 - protein, 19 aa, Drosophila melanogaster
RGTGAGGGGVGSGGGSKRS

SEQ ID NO: 19098 - protein, 19 aa, Drosophila melanogaster
RGTGAGGGGVGSGGGSKRS

SEQ ID NO: 19099 - protein, 17 aa, Drosophila melanogaster
RSLGGGGSKSDFATAKK

SEQ ID NO: 19100 - protein, 14 aa, Drosophila melanogaster
RLLEDGKGDPNTKI

SEQ ID NO: 19101 - protein, 14 aa, Drosophila melanogaster
RLLEDGKGDPNTKI

SEQ ID NO: 19102 - protein, 20 aa, Drosophila melanogaster
RTHTTQETDGFQVKRPGDRN

SEQ ID NO: 19103 - protein, 20 aa, Drosophila melanogaster
RTHTTQETDGFQVKRPGDRN

SEQ ID NO: 19104 - protein, 5 aa, Drosophila melanogaster
RKLRI

SEQ ID NO: 19105 - protein, 16 aa, Drosophila melanogaster
RLLEDGKGDPNTKIKR

SEQ ID NO: 19106 - protein, 16 aa, Drosophila melanogaster
RLLEDGKGDPNTKIKR

SEQ ID NO: 19107 - protein, 18 aa, Drosophila melanogaster
RDLKLMTDVAGNPEEERR

SEQ ID NO: 19108 - protein, 18 aa, Drosophila melanogaster
RDLKLMTDVAGNPEEERR

SEQ ID NO: 19109 - protein, 18 aa, Drosophila melanogaster
RDLKLMTDVAGNPEEERR

SEQ ID NO: 19110 - protein, 18 aa, Drosophila melanogaster
RDLKLMTDVAGNPEEERR

SEQ ID NO: 19111 - protein, 20 aa, Drosophila melanogaster
RTHTTQETDGFQVKRPGDRN

SEQ ID NO: 19112 - protein, 30 aa, Drosophila melanogaster
RIFISNTFYPSKEPTNDGEEGAVASWELRV

SEQ ID NO: 19113 - protein, 30 aa, Drosophila melanogaster; identical to SEQ ID NO: 19112

SEQ ID NO: 19114 - protein, 30 aa, Drosophila melanogaster; identical to SEQ ID NO: 19112

SEQ ID NO: 19115 - protein, 30 aa, Drosophila melanogaster; identical to SEQ ID NO: 19112

SEQ ID NO: 19116 - protein, 30 aa, Drosophila melanogaster; identical to SEQ ID NO: 19112

SEQ ID NO: 19117 - protein, 30 aa, Drosophila melanogaster; identical to SEQ ID NO: 19112

SEQ ID NO: 19118 - protein, 30 aa, Drosophila melanogaster; identical to SEQ ID NO: 19112

SEQ ID NO: 19119 - protein, 30 aa, Drosophila melanogaster; identical to SEQ ID NO: 19112

SEQ ID NO: 19120 - protein, 30 aa, Drosophila melanogaster; identical to SEQ ID NO: 19112

SEQ ID NO: 19121 - protein, 34 aa, Drosophila melanogaster
RIFISNTFYPSKEPTNDGEEGAVASWELRVEGRL

SEQ ID NO: 19122 - protein, 30 aa, Drosophila melanogaster; identical to SEQ ID NO: 19112

SEQ ID NO: 19123 - protein, 30 aa, Drosophila melanogaster; identical to SEQ ID NO: 19112

SEQ ID NO: 19124 - protein, 30 aa, Drosophila melanogaster; identical to SEQ ID NO: 19112

SEQ ID NO: 19125 - protein, 30 aa, Drosophila melanogaster; identical to SEQ ID NO: 19112

SEQ ID NO: 19126 - protein, 30 aa, Drosophila melanogaster; identical to SEQ ID NO: 19112

SEQ ID NO: 19127 - protein, 30 aa, Drosophila melanogaster; identical to SEQ ID NO: 19112

SEQ ID NO: 19128 - protein, 7 aa, Drosophila melanogaster
KKLAEKI

SEQ ID NO: 19129 - protein, 7 aa, Drosophila melanogaster
KKLAEKI

SEQ ID NO: 19130 - protein, 7 aa, Drosophila melanogaster
KKLAEKI

SEQ ID NO: 19131 - protein, 13 aa, Drosophila melanogaster
KLAEKILPQKVRD

SEQ ID NO: 19132 - protein, 9 aa, Drosophila melanogaster
KILPQKVRD

SEQ ID NO: 19133 - protein, 9 aa, Drosophila melanogaster
KILPQKVRD

SEQ ID NO: 19134 - protein, 13 aa, Drosophila melanogaster
KLAEKILPQKVRD

SEQ ID NO: 19135 - protein, 9 aa, Drosophila melanogaster
KILPQKVRD

SEQ ID NO: 19136 - protein, 9 aa, Drosophila melanogaster
KILPQKVRD

SEQ ID NO: 19137 - protein, 9 aa, Drosophila melanogaster
KILPQKVRD

SEQ ID NO: 19138 - protein, 13 aa, Drosophila melanogaster
KLAEKILPQKVRD

SEQ ID NO: 19139 - protein, 11 aa, Drosophila melanogaster
RMKFAEIPQRL

SEQ ID NO: 19140 - protein, 11 aa, Drosophila melanogaster
RMKFAEIPQRL

SEQ ID NO: 19141 - protein, 11 aa, Drosophila melanogaster
RMKFAEIPQRL

SEQ ID NO: 19142 - protein, 11 aa, Drosophila melanogaster
RMKFAEIPQRL

SEQ ID NO: 19143 - protein, 19 aa, Drosophila melanogaster
REYINCDKYLEQIFSCQRM

SEQ ID NO: 19144 - protein, 19 aa, Drosophila melanogaster
REYINCDKYLEQIFSCQRM

SEQ ID NO: 19145 - protein, 19 aa, Drosophila melanogaster
REYINCDKYLEQIFSCQRM

SEQ ID NO: 19146 - protein, 19 aa, Drosophila melanogaster
REYINCDKYLEQIFSCQRM

SEQ ID NO: 19147 - protein, 10 aa, Drosophila melanogaster
KSDFATAKKK

SEQ ID NO: 19148 - protein, 37 aa, Drosophila melanogaster
KAEIPSVVGIGAAPETNLDPETKTDNNATPNNADQRK

SEQ ID NO: 19149 - protein, 37 aa, Drosophila melanogaster; identical to SEQ ID NO: 19148

SEQ ID NO: 19150 - protein, 14 aa, Drosophila melanogaster
RRTNANVEGTPKRG

SEQ ID NO: 19151 - protein, 14 aa, Drosophila melanogaster
RRTNANVEGTPKRG

SEQ ID NO: 19152 - protein, 14 aa, Drosophila melanogaster
RRTNANVEGTPKRG

SEQ ID NO: 19153 - protein, 14 aa, Drosophila melanogaster
RRTNANVEGTPKRG

SEQ ID NO: 19154 - protein, 5 aa, Drosophila melanogaster
KKIRD

SEQ ID NO: 19155 - protein, 5 aa, Drosophila melanogaster
KKIRD

SEQ ID NO: 19156 - protein, 13 aa, Drosophila melanogaster
RLDMELEGQKLRD

SEQ ID NO: 19157 - protein, 13 aa, Drosophila melanogaster
RLDMELEGQKLRD

SEQ ID NO: 19158 - protein, 13 aa, Drosophila melanogaster
RLDMELEGQKLRD

SEQ ID NO: 19159 - protein, 12 aa, Drosophila melanogaster
RKRTELASSSRK

SEQ ID NO: 19160 - protein, 8 aa, Drosophila melanogaster
KKPAAMRN

SEQ ID NO: 19161 - protein, 20 aa, Drosophila melanogaster
KANAALQSTASPAPGGKSRG

SEQ ID NO: 19162 - protein, 17 aa, Drosophila melanogaster
KESSGSSPSGDKSAIKS

SEQ ID NO: 19163 - protein, 17 aa, Drosophila melanogaster
KESSGSSPSGDKSAIKS

SEQ ID NO: 19164 - protein, 17 aa, Drosophila melanogaster
KESSGSSPSGDKSAIKS

SEQ ID NO: 19165 - protein, 12 aa, Drosophila melanogaster
KKPAASSGGGKQ

SEQ ID NO: 19166 - protein, 12 aa, Drosophila melanogaster
KKPAASSGGGKQ

SEQ ID NO: 19167 - protein, 12 aa, Drosophila melanogaster
KKPAASSGGGKQ

SEQ ID NO: 19168 - protein, 12 aa, Drosophila melanogaster
KKPAASSGGGKQ

SEQ ID NO: 19169 - protein, 12 aa, Drosophila melanogaster
KKPAASSGGGKQ

SEQ ID NO: 19170 - protein, 12 aa, Drosophila melanogaster
KKPAASSGGGKQ

SEQ ID NO: 19171 - protein, 25 aa, Drosophila melanogaster
KKDGSPNIDFFQSPETLQGFESIRQ

SEQ ID NO: 19172 - protein, 25 aa, Drosophila melanogaster
KKDGSPNIDFFQSPETLQGFESIRQ

SEQ ID NO: 19173 - protein, 25 aa, Drosophila melanogaster
KKDGSPNIDFFQSPETLQGFESIRQ

SEQ ID NO: 19174 - protein, 25 aa, Drosophila melanogaster
KKDGSPNIDFFQSPETLQGFESIRQ

SEQ ID NO: 19175 - protein, 25 aa, Drosophila melanogaster
KKDGSPNIDFFQSPETLQGFESIRQ

SEQ ID NO: 19176 - protein, 25 aa, Drosophila melanogaster
KKDGSPNIDFFQSPETLQGFESIRQ

SEQ ID NO: 19177 - protein, 13 aa, Drosophila melanogaster
RAMPEFFNSKNKS

SEQ ID NO: 19178 - protein, 13 aa, Drosophila melanogaster
RAMPEFFNSKNKS

SEQ ID NO: 19179 - protein, 13 aa, Drosophila melanogaster
RAMPEFFNSKNKS

SEQ ID NO: 19180 - protein, 13 aa, Drosophila melanogaster
RAMPEFFNSKNKS

SEQ ID NO: 19181 - protein, 18 aa, Drosophila melanogaster
KDGGLELGDKSGLTGIKT

SEQ ID NO: 19182 - protein, 18 aa, Drosophila melanogaster
KDGGLELGDKSGLTGIKT

SEQ ID NO: 19183 - protein, 18 aa, Drosophila melanogaster
KDGGLELGDKSGLTGIKT

SEQ ID NO: 19184 - protein, 18 aa, Drosophila melanogaster
KDGGLELGDKSGLTGIKT

SEQ ID NO: 19185 - protein, 18 aa, Drosophila melanogaster
KDGGLELGDKSGLTGIKT

SEQ ID NO: 19186 - protein, 15 aa, Drosophila melanogaster
KKSRNDDDDEDLTRD

SEQ ID NO: 19187 - protein, 15 aa, Drosophila melanogaster
KKSRNDDDDEDLTRD

SEQ ID NO: 19188 - protein, 9 aa, Drosophila melanogaster
KGFEGKLRE

SEQ ID NO: 19189 - protein, 10 aa, Drosophila melanogaster
RSPAVVHKKS

SEQ ID NO: 19190 - protein, 10 aa, Drosophila melanogaster
KKDDDAKSKD

SEQ ID NO: 19191 - protein, 10 aa, Drosophila melanogaster
KKDDDAKSKD

SEQ ID NO: 19192 - protein, 12 aa, Drosophila melanogaster
KAKHLAALEERK

SEQ ID NO: 19193 - protein, 12 aa, Drosophila melanogaster
KAKHLAALEERK

SEQ ID NO: 19194 - protein, 30 aa, Drosophila melanogaster
KTEALENGAAGGLSSGVSQFGLKLDQYAKK

SEQ ID NO: 19195 - protein, 30 aa, Drosophila melanogaster; identical to SEQ ID NO: 19194

SEQ ID NO: 19196 - protein, 30 aa, Drosophila melanogaster; identical to SEQ ID NO: 19194

SEQ ID NO: 19197 - protein, 30 aa, Drosophila melanogaster; identical to SEQ ID NO: 19194

SEQ ID NO: 19198 - protein, 15 aa, Drosophila melanogaster
KKSRNDDDDEDLTRD

SEQ ID NO: 19199 - protein, 12 aa, Drosophila melanogaster
KNVEKASAGGKF

SEQ ID NO: 19200 - protein, 13 aa, Drosophila melanogaster
KKKPAASSGGGKQ

SEQ ID NO: 19201 - protein, 8 aa, Drosophila melanogaster
KKTHKQRM

SEQ ID NO: 19202 - protein, 8 aa, Drosophila melanogaster
KKTHKQRM

SEQ ID NO: 19203 - protein, 13 aa, Drosophila melanogaster
KKKPAASSGGGKQ

SEQ ID NO: 19204 - protein, 12 aa, Drosophila melanogaster
KKPAASSGGGKQ

SEQ ID NO: 19205 - protein, 12 aa, Drosophila melanogaster
KKPAASSGGGKQ

SEQ ID NO: 19206 - protein, 14 aa, Drosophila melanogaster
KKPAASSGGGKQKR

SEQ ID NO: 19207 - protein, 14 aa, Drosophila melanogaster
KKPAASSGGGKQKR

SEQ ID NO: 19208 - protein, 10 aa, Drosophila melanogaster
RSPAVVHKKS

SEQ ID NO: 19209 - protein, 14 aa, Drosophila melanogaster
KLGKNSADPPATRI

SEQ ID NO: 19210 - protein, 12 aa, Drosophila melanogaster
KAKHLAALEERK

SEQ ID NO: 19211 - protein, 20 aa, Drosophila melanogaster
KANAALQSTASPAPGGKSRG

SEQ ID NO: 19212 - protein, 20 aa, Drosophila melanogaster
KANAALQSTASPAPGGKSRG

SEQ ID NO: 19213 - protein, 45 aa, Drosophila melanogaster
KSRGDNDMMPIKGGTMTDLDDEMTGGSAAQAMSTGDGENSQTGKT

SEQ ID NO: 19214 - protein, 19 aa, Drosophila melanogaster
RIPYIYIRPEIEKGFEGKL

SEQ ID NO: 19215 - protein, 19 aa, Drosophila melanogaster
RIPYIYIRPEIEKGFEGKL

SEQ ID NO: 19216 - protein, 19 aa, Drosophila melanogaster
RIPYIYIRPEIEKGFEGKL

SEQ ID NO: 19217 - protein, 8 aa, Drosophila melanogaster
KKPAAMRN

SEQ ID NO: 19218 - protein, 8 aa, Drosophila melanogaster
KKPAAMRN

SEQ ID NO: 19219 - protein, 15 aa, Drosophila melanogaster
KPLGKDGGLELGDKS

SEQ ID NO: 19220 - protein, 15 aa, Drosophila melanogaster
KPLGKDGGLELGDKS

SEQ ID NO: 19221 - protein, 15 aa, Drosophila melanogaster
KPLGKDGGLELGDKS

SEQ ID NO: 19222 - protein, 15 aa, Drosophila melanogaster
KPLGKDGGLELGDKS

SEQ ID NO: 19223 - protein, 22 aa, Drosophila melanogaster
KPLGKDGGLELGDKSGLTGIKT

SEQ ID NO: 19224 - protein, 18 aa, Drosophila melanogaster
KDGGLELGDKSGLTGIKT

SEQ ID NO: 19225 - protein, 18 aa, Drosophila melanogaster
KDGGLELGDKSGLTGIKT

SEQ ID NO: 19226 - protein, 31 aa, Drosophila melanogaster
KSGLTGIKTEALENGAAGGLSSGVSQFGLKL

SEQ ID NO: 19227 - protein, 10 aa, Drosophila melanogaster
KTLLDLDKKP

SEQ ID NO: 19228 - protein, 11 aa, Drosophila melanogaster
KSKDNTKSDKT

SEQ ID NO: 19229 - protein, 13 aa, Drosophila melanogaster
KKKPAASSGGGKQ

SEQ ID NO: 19230 - protein, 14 aa, Drosophila melanogaster
KLGKNSADPPATRI

SEQ ID NO: 19231 - protein, 12 aa, Drosophila melanogaster
KAKHLAALEERK

SEQ ID NO: 19232 - protein, 12 aa, Drosophila melanogaster
KAKHLAALEERK

SEQ ID NO: 19233 - protein, 12 aa, Drosophila melanogaster
KAKHLAALEERK

SEQ ID NO: 19234 - protein, 12 aa, Drosophila melanogaster
KAKHLAALEERK

SEQ ID NO: 19235 - protein, 12 aa, Drosophila melanogaster
KAKHLAALEERK

SEQ ID NO: 19236 - protein, 13 aa, Drosophila melanogaster
KFDFSIGKNPTRK

SEQ ID NO: 19237 - protein, 14 aa, Drosophila melanogaster
KKFDFSIGKNPTRK

SEQ ID NO: 19238 - protein, 14 aa, Drosophila melanogaster
KKFDFSIGKNPTRK

SEQ ID NO: 19239 - protein, 23 aa, Drosophila melanogaster
KSNKSSPTETAAAASGGEVDIKT

SEQ ID NO: 19240 - protein, 23 aa, Drosophila melanogaster
KSNKSSPTETAAAASGGEVDIKT

SEQ ID NO: 19241 - protein, 23 aa, Drosophila melanogaster
KSNKSSPTETAAAASGGEVDIKT

SEQ ID NO: 19242 - protein, 23 aa, Drosophila melanogaster
KSNKSSPTETAAAASGGEVDIKT

SEQ ID NO: 19243 - protein, 12 aa, Drosophila melanogaster
KAKHLAALEERK

SEQ ID NO: 19244 - protein, 12 aa, Drosophila melanogaster
KAKHLAALEERK

SEQ ID NO: 19245 - protein, 12 aa, Drosophila melanogaster
KAKHLAALEERK

SEQ ID NO: 19246 - protein, 12 aa, Drosophila melanogaster
KAKHLAALEERK

SEQ ID NO: 19247 - protein, 12 aa, Drosophila melanogaster
KAKHLAALEERK

SEQ ID NO: 19248 - protein, 12 aa, Drosophila melanogaster
KAKHLAALEERK

SEQ ID NO: 19249 - protein, 12 aa, Drosophila melanogaster
KAKHLAALEERK

SEQ ID NO: 19250 - protein, 12 aa, Drosophila melanogaster
KAKHLAALEERK

SEQ ID NO: 19251 - protein, 12 aa, Drosophila melanogaster
KAKHLAALEERK

SEQ ID NO: 19252 - protein, 12 aa, Drosophila melanogaster
KAKHLAALEERK

SEQ ID NO: 19253 - protein, 12 aa, Drosophila melanogaster
KAKHLAALEERK

SEQ ID NO: 19254 - protein, 12 aa, Drosophila melanogaster
KAKHLAALEERK

SEQ ID NO: 19255 - protein, 12 aa, Drosophila melanogaster
KAKHLAALEERK

SEQ ID NO: 19256 - protein, 12 aa, Drosophila melanogaster
KAKHLAALEERK

SEQ ID NO: 19257 - protein, 12 aa, Drosophila melanogaster
KAKHLAALEERK

SEQ ID NO: 19258 - protein, 12 aa, Drosophila melanogaster
KAKHLAALEERK

SEQ ID NO: 19259 - protein, 12 aa, Drosophila melanogaster
KAKHLAALEERK

SEQ ID NO: 19260 - protein, 12 aa, Drosophila melanogaster
KAKHLAALEERK

SEQ ID NO: 19261 - protein, 12 aa, Drosophila melanogaster
KAKHLAALEERK

SEQ ID NO: 19262 - protein, 12 aa, Drosophila melanogaster
KDLSKKDDDAKS

SEQ ID NO: 19263 - protein, 43 aa, Drosophila melanogaster
KFNPNFGLANSGIAGTGNDKDDEEGKEGGASASAGGSDEEMKD

SEQ ID NO: 19264 - protein, 8 aa, Drosophila melanogaster
KKPAAMRN

SEQ ID NO: 19265 - protein, 9 aa, Drosophila melanogaster
RAKDDIKRV

SEQ ID NO: 19266 - protein, 9 aa, Drosophila melanogaster
RAKDDIKRV

SEQ ID NO: 19267 - protein, 13 aa, Drosophila melanogaster
RKKEDEEIHPGRE

SEQ ID NO: 19268 - protein, 13 aa, Drosophila melanogaster
RKKEDEEIHPGRE

SEQ ID NO: 19269 - protein, 13 aa, Drosophila melanogaster
RKKEDEEIHPGRE

SEQ ID NO: 19270 - protein, 13 aa, Drosophila melanogaster
RKKEDEEIHPGRE

SEQ ID NO: 19271 - protein, 13 aa, Drosophila melanogaster
RKKEDEEIHPGRE

SEQ ID NO: 19272 - protein, 12 aa, Drosophila melanogaster
RSEEEIEIFKRM

SEQ ID NO: 19273 - protein, 13 aa, Drosophila melanogaster
RKKEDEEIHPGRE

SEQ ID NO: 19274 - protein, 13 aa, Drosophila melanogaster
RKKEDEEIHPGRE

SEQ ID NO: 19275 - protein, 13 aa, Drosophila melanogaster
RKKEDEEIHPGRE

SEQ ID NO: 19276 - protein, 13 aa, Drosophila melanogaster
RKKEDEEIHPGRE

SEQ ID NO: 19277 - protein, 13 aa, Drosophila melanogaster
RKKEDEEIHPGRE

SEQ ID NO: 19278 - protein, 13 aa, Drosophila melanogaster
RKKEDEEIHPGRE

SEQ ID NO: 19279 - protein, 13 aa, Drosophila melanogaster
RKKEDEEIHPGRE

SEQ ID NO: 19280 - protein, 13 aa, Drosophila melanogaster
RKKEDEEIHPGRE

SEQ ID NO: 19281 - protein, 13 aa, Drosophila melanogaster
RKKEDEEIHPGRE

SEQ ID NO: 19282 - protein, 13 aa, Drosophila melanogaster
RKKEDEEIHPGRE

SEQ ID NO: 19283 - protein, 14 aa, Drosophila melanogaster
RTLSEPFMKLPSRQ

SEQ ID NO: 19284 - protein, 7 aa, Drosophila melanogaster
KKEQERI

SEQ ID NO: 19285 - protein, 10 aa, Drosophila melanogaster
RNNKAQLARM

SEQ ID NO: 19286 - protein, 10 aa, Drosophila melanogaster
RNNKAQLARM

SEQ ID NO: 19287 - protein, 10 aa, Drosophila melanogaster
RNNKAQLARM

SEQ ID NO: 19288 - protein, 10 aa, Drosophila melanogaster
RNNKAQLARM

SEQ ID NO: 19289 - protein, 10 aa, Drosophila melanogaster
RNNKAQLARM

SEQ ID NO: 19290 - protein, 10 aa, Drosophila melanogaster
RNNKAQLARM

SEQ ID NO: 19291 - protein, 7 aa, Drosophila melanogaster
KKEQERI

SEQ ID NO: 19292 - protein, 10 aa, Drosophila melanogaster
REQKKEQERI

SEQ ID NO: 19293 - protein, 10 aa, Drosophila melanogaster
REQKKEQERI

SEQ ID NO: 19294 - protein, 7 aa, Drosophila melanogaster
RIEKERM

SEQ ID NO: 19295 - protein, 7 aa, Drosophila melanogaster
RIEKERM

SEQ ID NO: 19296 - protein, 10 aa, Drosophila melanogaster
REQKKEQERI

SEQ ID NO: 19297 - protein, 12 aa, Drosophila melanogaster
RPVDIKKILQRI

SEQ ID NO: 19298 - protein, 12 aa, Drosophila melanogaster
RPVDIKKILQRI

SEQ ID NO: 19299 - protein, 17 aa, Drosophila melanogaster
RLDGTTKAEDRGELLRK

SEQ ID NO: 19300 - protein, 17 aa, Drosophila melanogaster
RLDGTTKAEDRGELLRK

SEQ ID NO: 19301 - protein, 12 aa, Drosophila melanogaster
RKLKTAVITERL

SEQ ID NO: 19302 - protein, 10 aa, Drosophila melanogaster
REQPLELKRV

SEQ ID NO: 19303 - protein, 10 aa, Drosophila melanogaster
REQPLELKRV

SEQ ID NO: 19304 - protein, 4 aa, Drosophila melanogaster
YSKR

SEQ ID NO: 19305 - protein, 13 aa, Drosophila melanogaster
HCKPAVDEETFQK

SEQ ID NO: 19306 - protein, 13 aa, Drosophila melanogaster
HCKPAVDEETFQK

SEQ ID NO: 19307 - protein, 13 aa, Drosophila melanogaster
HCKPAVDEETFQK

SEQ ID NO: 19308 - protein, 13 aa, Drosophila melanogaster
HCKPAVDEETFQK

SEQ ID NO: 19309 - protein, 13 aa, Drosophila melanogaster
HCKPAVDEETFQK

SEQ ID NO: 19310 - protein, 14 aa, Drosophila melanogaster
MVESSEAFQEELKR

SEQ ID NO: 19311 - protein, 13 aa, Drosophila melanogaster
HCKPAVDEETFQK

SEQ ID NO: 19312 - protein, 13 aa, Drosophila melanogaster
HCKPAVDEETFQK

SEQ ID NO: 19313 - protein, 14 aa, Drosophila melanogaster
MVESSEAFQEELKR

SEQ ID NO: 19314 - protein, 13 aa, Drosophila melanogaster
HCKPAVDEETFQK

SEQ ID NO: 19315 - protein, 11 aa, Drosophila melanogaster
SSSSKNQNESR

SEQ ID NO: 19316 - protein, 11 aa, Drosophila melanogaster
SSSSKNQNESR

SEQ ID NO: 19317 - protein, 11 aa, Drosophila melanogaster
SSSSKNQNESR

SEQ ID NO: 19318 - protein, 10 aa, Drosophila melanogaster
GGGSKSQHER

SEQ ID NO: 19319 - protein, 10 aa, Drosophila melanogaster
GGGSKSQHER

SEQ ID NO: 19320 - protein, 10 aa, Drosophila melanogaster
GGGSKSQHER

SEQ ID NO: 19321 - protein, 11 aa, Drosophila melanogaster
SSSSKNQNESR

SEQ ID NO: 19322 - protein, 11 aa, Drosophila melanogaster
SSSSKNQNESR

SEQ ID NO: 19323 - protein, 26 aa, Drosophila melanogaster
RIDIQPAEDEDDQDEGYTTKHLAYAR

SEQ ID NO: 19324 - protein, 26 aa, Drosophila melanogaster
RIDIQPAEDEDDQDEGYTTKHLAYAR

SEQ ID NO: 19325 - protein, 10 aa, Drosophila melanogaster
GGGSKSQHER

SEQ ID NO: 19326 - protein, 26 aa, Drosophila melanogaster
RIDIQPAEDEDDQDEGYTTKHLAYAR

SEQ ID NO: 19327 - protein, 25 aa, Drosophila melanogaster
NKDQTPIFTHSNYGNPAFTPQKVTK

SEQ ID NO: 19328 - protein, 25 aa, Drosophila melanogaster
NKDQTPIFTHSNYGNPAFTPQKVTK

SEQ ID NO: 19329 - protein, 25 aa, Drosophila melanogaster
NKDQTPIFTHSNYGNPAFTPQKVTK

SEQ ID NO: 19330 - protein, 13 aa, Drosophila melanogaster
VKTDVDMHETPSR

SEQ ID NO: 19331 - protein, 13 aa, Drosophila melanogaster
VKTDVDMHETPSR

SEQ ID NO: 19332 - protein, 13 aa, Drosophila melanogaster
VKTDVDMHETPSR

SEQ ID NO: 19333 - protein, 13 aa, Drosophila melanogaster
VKTDVDMHETPSR

SEQ ID NO: 19334 - protein, 10 aa, Drosophila melanogaster
GGGSKSQHER

SEQ ID NO: 19335 - protein, 25 aa, Drosophila melanogaster
NKDQTPIFTHSNYGNPAFTPQKVTK

SEQ ID NO: 19336 - protein, 25 aa, Drosophila melanogaster
NKDQTPIFTHSNYGNPAFTPQKVTK

SEQ ID NO: 19337 - protein, 9 aa, Drosophila melanogaster
MKFAEIPQR

SEQ ID NO: 19338 - protein, 12 aa, Drosophila melanogaster
LLEDGKGDPNTK

SEQ ID NO: 19339 - protein, 7 aa, Drosophila melanogaster
KFSSFFK

SEQ ID NO: 19340 - protein, 14 aa, Drosophila melanogaster
LLEDGKGDPNTKIK

SEQ ID NO: 19341 - protein, 8 aa, Drosophila melanogaster
KLDATIMR

SEQ ID NO: 19342 - protein, 8 aa, Drosophila melanogaster
KLDATIMR

SEQ ID NO: 19343 - protein, 8 aa, Drosophila melanogaster
KLDATIMR

SEQ ID NO: 19344 - protein, 8 aa, Drosophila melanogaster
KLDATIMR

SEQ ID NO: 19345 - protein, 8 aa, Drosophila melanogaster
KLDATIMR

SEQ ID NO: 19346 - protein, 8 aa, Drosophila melanogaster
KLDATIMR

SEQ ID NO: 19347 - protein, 8 aa, Drosophila melanogaster
KLDATIMR

SEQ ID NO: 19348 - protein, 8 aa, Drosophila melanogaster
KLDATIMR

SEQ ID NO: 19349 - protein, 8 aa, Drosophila melanogaster
KLDATIMR

SEQ ID NO: 19350 - protein, 8 aa, Drosophila melanogaster
KLDATIMR

SEQ ID NO: 19351 - protein, 7 aa, Drosophila melanogaster
KFSSFFK

SEQ ID NO: 19352 - protein, 8 aa, Drosophila melanogaster
KLDATIMR

SEQ ID NO: 19353 - protein, 15 aa, Drosophila melanogaster
IHETVDTINQMKTNR

SEQ ID NO: 19354 - protein, 15 aa, Drosophila melanogaster
IHETVDTINQMKTNR

SEQ ID NO: 19355 - protein, 15 aa, Drosophila melanogaster
IHETVDTINQMKTNR

SEQ ID NO: 19356 - protein, 15 aa, Drosophila melanogaster
IHETVDTINQMKTNR

SEQ ID NO: 19357 - protein, 15 aa, Drosophila melanogaster
IHETVDTINQMKTNR

SEQ ID NO: 19358 - protein, 15 aa, Drosophila melanogaster
IHETVDTINQMKTNR

SEQ ID NO: 19359 - protein, 15 aa, Drosophila melanogaster
IHETVDTINQMKTNR

SEQ ID NO: 19360 - protein, 15 aa, Drosophila melanogaster
IHETVDTINQMKTNR

SEQ ID NO: 19361 - protein, 15 aa, Drosophila melanogaster
IHETVDTINQMKTNR

SEQ ID NO: 19362 - protein, 15 aa, Drosophila melanogaster
IHETVDTINQMKTNR

SEQ ID NO: 19363 - protein, 15 aa, Drosophila melanogaster
IHETVDTINQMKTNR

SEQ ID NO: 19364 - protein, 15 aa, Drosophila melanogaster
IHETVDTINQMKTNR

SEQ ID NO: 19365 - protein, 15 aa, Drosophila melanogaster
IHETVDTINQMKTNR

SEQ ID NO: 19366 - protein, 15 aa, Drosophila melanogaster
IHETVDTINQMKTNR

SEQ ID NO: 19367 - protein, 15 aa, Drosophila melanogaster
IHETVDTINQMKTNR

SEQ ID NO: 19368 - protein, 15 aa, Drosophila melanogaster
IHETVDTINQMKTNR

SEQ ID NO: 19369 - protein, 15 aa, Drosophila melanogaster
IHETVDTINQMKTNR

SEQ ID NO: 19370 - protein, 15 aa, Drosophila melanogaster
IHETVDTINQMKTNR

SEQ ID NO: 19371 - protein, 15 aa, Drosophila melanogaster
IHETVDTINQMKTNR

SEQ ID NO: 19372 - protein, 15 aa, Drosophila melanogaster
IHETVDTINQMKTNR

SEQ ID NO: 19373 - protein, 15 aa, Drosophila melanogaster
IHETVDTINQMKTNR

SEQ ID NO: 19374 - protein, 15 aa, Drosophila melanogaster
IHETVDTINQMKTNR

SEQ ID NO: 19375 - protein, 15 aa, Drosophila melanogaster
IHETVDTINQMKTNR

SEQ ID NO: 19376 - protein, 15 aa, Drosophila melanogaster
IHETVDTINQMKTNR

SEQ ID NO: 19377 - protein, 15 aa, Drosophila melanogaster
IHETVDTINQMKTNR

SEQ ID NO: 19378 - protein, 15 aa, Drosophila melanogaster
IHETVDTINQMKTNR

SEQ ID NO: 19379 - protein, 15 aa, Drosophila melanogaster
IHETVDTINQMKTNR

SEQ ID NO: 19380 - protein, 15 aa, Drosophila melanogaster
IHETVDTINQMKTNR

SEQ ID NO: 19381 - protein, 15 aa, Drosophila melanogaster
IHETVDTINQMKTNR

SEQ ID NO: 19382 - protein, 15 aa, Drosophila melanogaster
IHETVDTINQMKTNR

SEQ ID NO: 19383 - protein, 15 aa, Drosophila melanogaster
IHETVDTINQMKTNR

SEQ ID NO: 19384 - protein, 15 aa, Drosophila melanogaster
IHETVDTINQMKTNR

SEQ ID NO: 19385 - protein, 15 aa, Drosophila melanogaster
IHETVDTINQMKTNR

SEQ ID NO: 19386 - protein, 15 aa, Drosophila melanogaster
IHETVDTINQMKTNR

SEQ ID NO: 19387 - protein, 15 aa, Drosophila melanogaster
IHETVDTINQMKTNR

SEQ ID NO: 19388 - protein, 15 aa, Drosophila melanogaster
IHETVDTINQMKTNR

SEQ ID NO: 19389 - protein, 15 aa, Drosophila melanogaster
IHETVDTINQMKTNR

SEQ ID NO: 19390 - protein, 15 aa, Drosophila melanogaster
IHETVDTINQMKTNR

SEQ ID NO: 19391 - protein, 15 aa, Drosophila melanogaster
IHETVDTINQMKTNR

SEQ ID NO: 19392 - protein, 15 aa, Drosophila melanogaster
IHETVDTINQMKTNR

SEQ ID NO: 19393 - protein, 15 aa, Drosophila melanogaster
IHETVDTINQMKTNR

SEQ ID NO: 19394 - protein, 15 aa, Drosophila melanogaster
IHETVDTINQMKTNR

SEQ ID NO: 19395 - protein, 15 aa, Drosophila melanogaster
IHETVDTINQMKTNR

SEQ ID NO: 19396 - protein, 15 aa, Drosophila melanogaster
IHETVDTINQMKTNR

SEQ ID NO: 19397 - protein, 15 aa, Drosophila melanogaster
IHETVDTINQMKTNR

SEQ ID NO: 19398 - protein, 15 aa, Drosophila melanogaster
IHETVDTINQMKTNR

SEQ ID NO: 19399 - protein, 15 aa, Drosophila melanogaster
IHETVDTINQMKTNR

SEQ ID NO: 19400 - protein, 15 aa, Drosophila melanogaster
IHETVDTINQMKTNR

SEQ ID NO: 19401 - protein, 15 aa, Drosophila melanogaster
IHETVDTINQMKTNR

SEQ ID NO: 19402 - protein, 15 aa, Drosophila melanogaster
IHETVDTINQMKTNR

SEQ ID NO: 19403 - protein, 15 aa, Drosophila melanogaster
IHETVDTINQMKTNR

SEQ ID NO: 19404 - protein, 15 aa, Drosophila melanogaster
IHETVDTINQMKTNR

SEQ ID NO: 19405 - protein, 15 aa, Drosophila melanogaster
IHETVDTINQMKTNR

SEQ ID NO: 19406 - protein, 15 aa, Drosophila melanogaster
IHETVDTINQMKTNR

SEQ ID NO: 19407 - protein, 15 aa, Drosophila melanogaster
IHETVDTINQMKTNR

SEQ ID NO: 19408 - protein, 15 aa, Drosophila melanogaster
IHETVDTINQMKTNR

SEQ ID NO: 19409 - protein, 15 aa, Drosophila melanogaster
IHETVDTINQMKTNR

SEQ ID NO: 19410 - protein, 15 aa, Drosophila melanogaster
IHETVDTINQMKTNR

SEQ ID NO: 19411 - protein, 15 aa, Drosophila melanogaster
IHETVDTINQMKTNR

SEQ ID NO: 19412 - protein, 15 aa, Drosophila melanogaster
IHETVDTINQMKTNR

SEQ ID NO: 19413 - protein, 15 aa, Drosophila melanogaster
IHETVDTINQMKTNR

SEQ ID NO: 19414 - protein, 15 aa, Drosophila melanogaster
IHETVDTINQMKTNR

SEQ ID NO: 19415 - protein, 15 aa, Drosophila melanogaster
IHETVDTINQMKTNR

SEQ ID NO: 19416 - protein, 15 aa, Drosophila melanogaster
IHETVDTINQMKTNR

SEQ ID NO: 19417 - protein, 15 aa, Drosophila melanogaster
IHETVDTINQMKTNR

SEQ ID NO: 19418 - protein, 15 aa, Drosophila melanogaster
IHETVDTINQMKTNR

SEQ ID NO: 19419 - protein, 15 aa, Drosophila melanogaster
IHETVDTINQMKTNR

SEQ ID NO: 19420 - protein, 15 aa, Drosophila melanogaster
IHETVDTINQMKTNR

SEQ ID NO: 19421 - protein, 15 aa, Drosophila melanogaster
IHETVDTINQMKTNR

SEQ ID NO: 19422 - protein, 15 aa, Drosophila melanogaster
IHETVDTINQMKTNR

SEQ ID NO: 19423 - protein, 15 aa, Drosophila melanogaster
IHETVDTINQMKTNR

SEQ ID NO: 19424 - protein, 15 aa, Drosophila melanogaster
IHETVDTINQMKTNR

SEQ ID NO: 19425 - protein, 15 aa, Drosophila melanogaster
IHETVDTINQMKTNR

SEQ ID NO: 19426 - protein, 15 aa, Drosophila melanogaster
IHETVDTINQMKTNR

SEQ ID NO: 19427 - protein, 9 aa, Drosophila melanogaster
YFFTKVNQK

SEQ ID NO: 19428 - protein, 9 aa, Drosophila melanogaster
YFFTKVNQK

SEQ ID NO: 19429 - protein, 9 aa, Drosophila melanogaster
YFFTKVNQK

SEQ ID NO: 19430 - protein, 9 aa, Drosophila melanogaster
YFFTKVNQK

SEQ ID NO: 19431 - protein, 15 aa, Drosophila melanogaster
IHETVDTINQMKTNR

SEQ ID NO: 19432 - protein, 14 aa, Drosophila melanogaster
LLEDGKGDPNTKIK

SEQ ID NO: 19433 - protein, 14 aa, Drosophila melanogaster
LLEDGKGDPNTKIK

SEQ ID NO: 19434 - protein, 7 aa, Drosophila melanogaster
KFSSFFK

SEQ ID NO: 19435 - protein, 14 aa, Drosophila melanogaster
LLEDGKGDPNTKIK

SEQ ID NO: 19436 - protein, 14 aa, Drosophila melanogaster
LLEDGKGDPNTKIK

SEQ ID NO: 19437 - protein, 14 aa, Drosophila melanogaster
LLEDGKGDPNTKIK

SEQ ID NO: 19438 - protein, 7 aa, Drosophila melanogaster
KFSSFFK

SEQ ID NO: 19439 - protein, 14 aa, Drosophila melanogaster
LLEDGKGDPNTKIK

SEQ ID NO: 19440 - protein, 14 aa, Drosophila melanogaster
LLEDGKGDPNTKIK

SEQ ID NO: 19441 - protein, 14 aa, Drosophila melanogaster
LLEDGKGDPNTKIK

SEQ ID NO: 19442 - protein, 9 aa, Drosophila melanogaster
GDPNTKIKR

SEQ ID NO: 19443 - protein, 9 aa, Drosophila melanogaster
MKFAEIPQR

SEQ ID NO: 19444 - protein, 9 aa, Drosophila melanogaster
MKFAEIPQR

SEQ ID NO: 19445 - protein, 9 aa, Drosophila melanogaster
MKFAEIPQR

SEQ ID NO: 19446 - protein, 9 aa, Drosophila melanogaster
MKFAEIPQR

SEQ ID NO: 19447 - protein, 9 aa, Drosophila melanogaster
MKFAEIPQR

SEQ ID NO: 19448 - protein, 9 aa, Drosophila melanogaster
MKFAEIPQR

SEQ ID NO: 19449 - protein, 9 aa, Drosophila melanogaster
MKFAEIPQR

SEQ ID NO: 19450 - protein, 9 aa, Drosophila melanogaster
MKFAEIPQR

SEQ ID NO: 19451 - protein, 9 aa, Drosophila melanogaster
MKFAEIPQR

SEQ ID NO: 19452 - protein, 9 aa, Drosophila melanogaster
MKFAEIPQR

SEQ ID NO: 19453 - protein, 9 aa, Drosophila melanogaster
YFFTKVNQK

SEQ ID NO: 19454 - protein, 9 aa, Drosophila melanogaster
YFFTKVNQK

SEQ ID NO: 19455 - protein, 9 aa, Drosophila melanogaster
YFFTKVNQK

SEQ ID NO: 19456 - protein, 9 aa, Drosophila melanogaster
YFFTKVNQK

SEQ ID NO: 19457 - protein, 16 aa, Drosophila melanogaster
DLKLMTDVAGNPEEER

SEQ ID NO: 19458 - protein, 9 aa, Drosophila melanogaster
YFFTKVNQK

SEQ ID NO: 19459 - protein, 17 aa, Drosophila melanogaster
GTGAGGGGVGSGGGSKR

SEQ ID NO: 19460 - protein, 18 aa, Drosophila melanogaster
THTTQETDGFQVKRPGDR

SEQ ID NO: 19461 - protein, 18 aa, Drosophila melanogaster
THTTQETDGFQVKRPGDR

SEQ ID NO: 19462 - protein, 18 aa, Drosophila melanogaster
THTTQETDGFQVKRPGDR

SEQ ID NO: 19463 - protein, 17 aa, Drosophila melanogaster
GTGAGGGGVGSGGGSKR

SEQ ID NO: 19464 - protein, 8 aa, Drosophila melanogaster
KLDATIMR

SEQ ID NO: 19465 - protein, 8 aa, Drosophila melanogaster
KLDATIMR

SEQ ID NO: 19466 - protein, 17 aa, Drosophila melanogaster
GTGAGGGGVGSGGGSKR

SEQ ID NO: 19467 - protein, 17 aa, Drosophila melanogaster
GTGAGGGGVGSGGGSKR

SEQ ID NO: 19468 - protein, 17 aa, Drosophila melanogaster
GTGAGGGGVGSGGGSKR

SEQ ID NO: 19469 - protein, 15 aa, Drosophila melanogaster
IHETVDTINQMKTNR

SEQ ID NO: 19470 - protein, 17 aa, Drosophila melanogaster
GTGAGGGGVGSGGGSKR

SEQ ID NO: 19471 - protein, 17 aa, Drosophila melanogaster
GTGAGGGGVGSGGGSKR

SEQ ID NO: 19472 - protein, 17 aa, Drosophila melanogaster
GTGAGGGGVGSGGGSKR

SEQ ID NO: 19473 - protein, 15 aa, Drosophila melanogaster
IHETVDTINQMKTNR

SEQ ID NO: 19474 - protein, 17 aa, Drosophila melanogaster
GTGAGGGGVGSGGGSKR

SEQ ID NO: 19475 - protein, 17 aa, Drosophila melanogaster
GTGAGGGGVGSGGGSKR

SEQ ID NO: 19476 - protein, 9 aa, Drosophila melanogaster
MKFAEIPQR

SEQ ID NO: 19477 - protein, 17 aa, Drosophila melanogaster
GTGAGGGGVGSGGGSKR

SEQ ID NO: 19478 - protein, 17 aa, Drosophila melanogaster
GTGAGGGGVGSGGGSKR

SEQ ID NO: 19479 - protein, 17 aa, Drosophila melanogaster
GTGAGGGGVGSGGGSKR

SEQ ID NO: 19480 - protein, 9 aa, Drosophila melanogaster
MKFAEIPQR

SEQ ID NO: 19481 - protein, 9 aa, Drosophila melanogaster
MKFAEIPQR

SEQ ID NO: 19482 - protein, 9 aa, Drosophila melanogaster
MKFAEIPQR

SEQ ID NO: 19483 - protein, 15 aa, Drosophila melanogaster
SLGGGGSKSDFATAK

SEQ ID NO: 19484 - protein, 15 aa, Drosophila melanogaster
SLGGGGSKSDFATAK

SEQ ID NO: 19485 - protein, 15 aa, Drosophila melanogaster
SLGGGGSKSDFATAK

SEQ ID NO: 19486 - protein, 8 aa, Drosophila melanogaster
SDFATAKK

SEQ ID NO: 19487 - protein, 17 aa, Drosophila melanogaster
GTGAGGGGVGSGGGSKR

SEQ ID NO: 19488 - protein, 17 aa, Drosophila melanogaster
GTGAGGGGVGSGGGSKR

SEQ ID NO: 19489 - protein, 17 aa, Drosophila melanogaster
GTGAGGGGVGSGGGSKR

SEQ ID NO: 19490 - protein, 17 aa, Drosophila melanogaster
GTGAGGGGVGSGGGSKR

SEQ ID NO: 19491 - protein, 17 aa, Drosophila melanogaster
GTGAGGGGVGSGGGSKR

SEQ ID NO: 19492 - protein, 17 aa, Drosophila melanogaster
GTGAGGGGVGSGGGSKR

SEQ ID NO: 19493 - protein, 15 aa, Drosophila melanogaster
SLGGGGSKSDFATAK

SEQ ID NO: 19494 - protein, 12 aa, Drosophila melanogaster
LLEDGKGDPNTK

SEQ ID NO: 19495 - protein, 12 aa, Drosophila melanogaster
LLEDGKGDPNTK

SEQ ID NO: 19496 - protein, 18 aa, Drosophila melanogaster
THTTQETDGFQVKRPGDR

SEQ ID NO: 19497 - protein, 18 aa, Drosophila melanogaster
THTTQETDGFQVKRPGDR

SEQ ID NO: 19498 - protein, 3 aa, Drosophila melanogaster
KLR

SEQ ID NO: 19499 - protein, 14 aa, Drosophila melanogaster
LLEDGKGDPNTKIK

SEQ ID NO: 19500 - protein, 14 aa, Drosophila melanogaster
LLEDGKGDPNTKIK

SEQ ID NO: 19501 - protein, 16 aa, Drosophila melanogaster
DLKLMTDVAGNPEEER

SEQ ID NO: 19502 - protein, 16 aa, Drosophila melanogaster
DLKLMTDVAGNPEEER

SEQ ID NO: 19503 - protein, 16 aa, Drosophila melanogaster
DLKLMTDVAGNPEEER

SEQ ID NO: 19504 - protein, 16 aa, Drosophila melanogaster
DLKLMTDVAGNPEEER

SEQ ID NO: 19505 - protein, 18 aa, Drosophila melanogaster
THTTQETDGFQVKRPGDR

SEQ ID NO: 19506 - protein, 28 aa, Drosophila melanogaster
IFISNTFYPSKEPTNDGEEGAVASWELR

SEQ ID NO: 19507 - protein, 28 aa, Drosophila melanogaster
IFISNTFYPSKEPTNDGEEGAVASWELR

SEQ ID NO: 19508 - protein, 28 aa, Drosophila melanogaster
IFISNTFYPSKEPTNDGEEGAVASWELR

SEQ ID NO: 19509 - protein, 28 aa, Drosophila melanogaster
IFISNTFYPSKEPTNDGEEGAVASWELR

SEQ ID NO: 19510 - protein, 28 aa, Drosophila melanogaster
IFISNTFYPSKEPTNDGEEGAVASWELR

SEQ ID NO: 19511 - protein, 28 aa, Drosophila melanogaster
IFISNTFYPSKEPTNDGEEGAVASWELR

SEQ ID NO: 19512 - protein, 28 aa, Drosophila melanogaster
IFISNTFYPSKEPTNDGEEGAVASWELR

SEQ ID NO: 19513 - protein, 28 aa, Drosophila melanogaster
IFISNTFYPSKEPTNDGEEGAVASWELR

SEQ ID NO: 19514 - protein, 28 aa, Drosophila melanogaster
IFISNTFYPSKEPTNDGEEGAVASWELR

SEQ ID NO: 19515 - protein, 32 aa, Drosophila melanogaster
IFISNTFYPSKEPTNDGEEGAVASWELRVEGR

SEQ ID NO: 19516 - protein, 28 aa, Drosophila melanogaster
IFISNTFYPSKEPTNDGEEGAVASWELR

SEQ ID NO: 19517 - protein, 28 aa, Drosophila melanogaster
IFISNTFYPSKEPTNDGEEGAVASWELR

SEQ ID NO: 19518 - protein, 28 aa, Drosophila melanogaster
IFISNTFYPSKEPTNDGEEGAVASWELR

SEQ ID NO: 19519 - protein, 28 aa, Drosophila melanogaster
IFISNTFYPSKEPTNDGEEGAVASWELR

SEQ ID NO: 19520 - protein, 28 aa, Drosophila melanogaster
IFISNTFYPSKEPTNDGEEGAVASWELR

SEQ ID NO: 19521 - protein, 28 aa, Drosophila melanogaster
IFISNTFYPSKEPTNDGEEGAVASWELR

SEQ ID NO: 19522 - protein, 5 aa, Drosophila melanogaster
KLAEK

SEQ ID NO: 19523 - protein, 5 aa, Drosophila melanogaster
KLAEK

SEQ ID NO: 19524 - protein, 5 aa, Drosophila melanogaster
KLAEK

SEQ ID NO: 19525 - protein, 11 aa, Drosophila melanogaster
LAEKILPQKVR

SEQ ID NO: 19526 - protein, 7 aa, Drosophila melanogaster
ILPQKVR

SEQ ID NO: 19527 - protein, 7 aa, Drosophila melanogaster
ILPQKVR

SEQ ID NO: 19528 - protein, 11 aa, Drosophila melanogaster
LAEKILPQKVR

SEQ ID NO: 19529 - protein, 7 aa, Drosophila melanogaster
ILPQKVR

SEQ ID NO: 19530 - protein, 7 aa, Drosophila melanogaster
ILPQKVR

SEQ ID NO: 19531 - protein, 7 aa, Drosophila melanogaster
ILPQKVR

SEQ ID NO: 19532 - protein, 11 aa, Drosophila melanogaster
LAEKILPQKVR

SEQ ID NO: 19533 - protein, 9 aa, Drosophila melanogaster
MKFAEIPQR

SEQ ID NO: 19534 - protein, 9 aa, Drosophila melanogaster
MKFAEIPQR

SEQ ID NO: 19535 - protein, 9 aa, Drosophila melanogaster
MKFAEIPQR

SEQ ID NO: 19536 - protein, 9 aa, Drosophila melanogaster
MKFAEIPQR

SEQ ID NO: 19537 - protein, 17 aa, Drosophila melanogaster
EYINCDKYLEQIFSCQR

SEQ ID NO: 19538 - protein, 17 aa, Drosophila melanogaster
EYINCDKYLEQIFSCQR

SEQ ID NO: 19539 - protein, 17 aa, Drosophila melanogaster
EYINCDKYLEQIFSCQR

SEQ ID NO: 19540 - protein, 17 aa, Drosophila melanogaster
EYINCDKYLEQIFSCQR

SEQ ID NO: 19541 - protein, 8 aa, Drosophila melanogaster
SDFATAKK

SEQ ID NO: 19542 - protein, 35 aa, Drosophila melanogaster
AEIPSVVGIGAAPETNLDPETKTDNNATPNNADQR

SEQ ID NO: 19543 - protein, 35 aa, Drosophila melanogaster; identical to SEQ ID NO: 19542

SEQ ID NO: 19544 - protein, 12 aa, Drosophila melanogaster
RTNANVEGTPKR

SEQ ID NO: 19545 - protein, 12 aa, Drosophila melanogaster
RTNANVEGTPKR

SEQ ID NO: 19546 - protein, 12 aa, Drosophila melanogaster
RTNANVEGTPKR

SEQ ID NO: 19547 - protein, 12 aa, Drosophila melanogaster
RTNANVEGTPKR

SEQ ID NO: 19548 - protein, 3 aa, Drosophila melanogaster
KIR

SEQ ID NO: 19549 - protein, 3 aa, Drosophila melanogaster
KIR

SEQ ID NO: 19550 - protein, 11 aa, Drosophila melanogaster
LDMELEGQKLR

SEQ ID NO: 19551 - protein, 11 aa, Drosophila melanogaster
LDMELEGQKLR

SEQ ID NO: 19552 - protein, 11 aa, Drosophila melanogaster
LDMELEGQKLR

SEQ ID NO: 19553 - protein, 10 aa, Drosophila melanogaster
KRTELASSSR

SEQ ID NO: 19554 - protein, 6 aa, Drosophila melanogaster
KPAAMR

SEQ ID NO: 19555 - protein, 18 aa, Drosophila melanogaster
ANAALQSTASPAPGGKSR

SEQ ID NO: 19556 - protein, 15 aa, Drosophila melanogaster
ESSGSSPSGDKSAIK

SEQ ID NO: 19557 - protein, 15 aa, Drosophila melanogaster
ESSGSSPSGDKSAIK

SEQ ID NO: 19558 - protein, 15 aa, Drosophila melanogaster
ESSGSSPSGDKSAIK

SEQ ID NO: 19559 - protein, 10 aa, Drosophila melanogaster
KPAASSGGGK

SEQ ID NO: 19560 - protein, 10 aa, Drosophila melanogaster
KPAASSGGGK

SEQ ID NO: 19561 - protein, 10 aa, Drosophila melanogaster
KPAASSGGGK

SEQ ID NO: 19562 - protein, 10 aa, Drosophila melanogaster
KPAASSGGGK

SEQ ID NO: 19563 - protein, 10 aa, Drosophila melanogaster
KPAASSGGGK

SEQ ID NO: 19564 - protein, 10 aa, Drosophila melanogaster
KPAASSGGGK

SEQ ID NO: 19565 - protein, 23 aa, Drosophila melanogaster
KDGSPNIDFFQSPETLQGFESIR

SEQ ID NO: 19566 - protein, 23 aa, Drosophila melanogaster
KDGSPNIDFFQSPETLQGFESIR

SEQ ID NO: 19567 - protein, 23 aa, Drosophila melanogaster
KDGSPNIDFFQSPETLQGFESIR

SEQ ID NO: 19568 - protein, 23 aa, Drosophila melanogaster
KDGSPNIDFFQSPETLQGFESIR

SEQ ID NO: 19569 - protein, 23 aa, Drosophila melanogaster
KDGSPNIDFFQSPETLQGFESIR

SEQ ID NO: 19570 - protein, 23 aa, Drosophila melanogaster
KDGSPNIDFFQSPETLQGFESIR

SEQ ID NO: 19571 - protein, 11 aa, Drosophila melanogaster
AMPEFFNSKNK

SEQ ID NO: 19572 - protein, 11 aa, Drosophila melanogaster
AMPEFFNSKNK

SEQ ID NO: 19573 - protein, 11 aa, Drosophila melanogaster
AMPEFFNSKNK

SEQ ID NO: 19574 - protein, 11 aa, Drosophila melanogaster
AMPEFFNSKNK

SEQ ID NO: 19575 - protein, 16 aa, Drosophila melanogaster
DGGLELGDKSGLTGIK

SEQ ID NO: 19576 - protein, 16 aa, Drosophila melanogaster
DGGLELGDKSGLTGIK

SEQ ID NO: 19577 - protein, 16 aa, Drosophila melanogaster
DGGLELGDKSGLTGIK

SEQ ID NO: 19578 - protein, 16 aa, Drosophila melanogaster
DGGLELGDKSGLTGIK

SEQ ID NO: 19579 - protein, 16 aa, Drosophila melanogaster
DGGLELGDKSGLTGIK

SEQ ID NO: 19580 - protein, 13 aa, Drosophila melanogaster
KSRNDDDDEDLTR

SEQ ID NO: 19581 - protein, 13 aa, Drosophila melanogaster
KSRNDDDDEDLTR

SEQ ID NO: 19582 - protein, 7 aa, Drosophila melanogaster
GFEGKLR

SEQ ID NO: 19583 - protein, 8 aa, Drosophila melanogaster
SPAVVHKK

SEQ ID NO: 19584 - protein, 8 aa, Drosophila melanogaster
KDDDAKSK

SEQ ID NO: 19585 - protein, 8 aa, Drosophila melanogaster
KDDDAKSK

SEQ ID NO: 19586 - protein, 10 aa, Drosophila melanogaster
AKHLAALEER

SEQ ID NO: 19587 - protein, 10 aa, Drosophila melanogaster
AKHLAALEER

SEQ ID NO: 19588 - protein, 28 aa, Drosophila melanogaster
TEALENGAAGGLSSGVSQFGLKLDQYAK

SEQ ID NO: 19589 - protein, 28 aa, Drosophila melanogaster
TEALENGAAGGLSSGVSQFGLKLDQYAK

SEQ ID NO: 19590 - protein, 28 aa, Drosophila melanogaster
TEALENGAAGGLSSGVSQFGLKLDQYAK

SEQ ID NO: 19591 - protein, 28 aa, Drosophila melanogaster
TEALENGAAGGLSSGVSQFGLKLDQYAK

SEQ ID NO: 19592 - protein, 13 aa, Drosophila melanogaster
KSRNDDDDEDLTR

SEQ ID NO: 19593 - protein, 10 aa, Drosophila melanogaster
NVEKASAGGK

SEQ ID NO: 19594 - protein, 11 aa, Drosophila melanogaster
KKPAASSGGGK

SEQ ID NO: 19595 - protein, 6 aa, Drosophila melanogaster
KTHKQR

SEQ ID NO: 19596 - protein, 6 aa, Drosophila melanogaster
KTHKQR

SEQ ID NO: 19597 - protein, 11 aa, Drosophila melanogaster
KKPAASSGGGK

SEQ ID NO: 19598 - protein, 10 aa, Drosophila melanogaster
KPAASSGGGK

SEQ ID NO: 19599 - protein, 10 aa, Drosophila melanogaster
KPAASSGGGK

SEQ ID NO: 19600 - protein, 12 aa, Drosophila melanogaster
KPAASSGGGKQK

SEQ ID NO: 19601 - protein, 12 aa, Drosophila melanogaster
KPAASSGGGKQK

SEQ ID NO: 19602 - protein, 8 aa, Drosophila melanogaster
SPAVVHKK

SEQ ID NO: 19603 - protein, 12 aa, Drosophila melanogaster
LGKNSADPPATR

SEQ ID NO: 19604 - protein, 10 aa, Drosophila melanogaster
AKHLAALEER

SEQ ID NO: 19605 - protein, 18 aa, Drosophila melanogaster
ANAALQSTASPAPGGKSR

SEQ ID NO: 19606 - protein, 18 aa, Drosophila melanogaster
ANAALQSTASPAPGGKSR

SEQ ID NO: 19607 - protein, 43 aa, Drosophila melanogaster
SRGDNDMMPIKGGTMTDLDDEMTGGSAAQAMSTGDGENSQTGK

SEQ ID NO: 19608 - protein, 17 aa, Drosophila melanogaster
IPYIYIRPEIEKGFEGK

SEQ ID NO: 19609 - protein, 17 aa, Drosophila melanogaster
IPYIYIRPEIEKGFEGK

SEQ ID NO: 19610 - protein, 17 aa, Drosophila melanogaster
IPYIYIRPEIEKGFEGK

SEQ ID NO: 19611 - protein, 6 aa, Drosophila melanogaster
KPAAMR

SEQ ID NO: 19612 - protein, 6 aa, Drosophila melanogaster
KPAAMR

SEQ ID NO: 19613 - protein, 13 aa, Drosophila melanogaster
PLGKDGGLELGDK

SEQ ID NO: 19614 - protein, 13 aa, Drosophila melanogaster
PLGKDGGLELGDK

SEQ ID NO: 19615 - protein, 13 aa, Drosophila melanogaster
PLGKDGGLELGDK

SEQ ID NO: 19616 - protein, 13 aa, Drosophila melanogaster
PLGKDGGLELGDK

SEQ ID NO: 19617 - protein, 20 aa, Drosophila melanogaster
PLGKDGGLELGDKSGLTGIK

SEQ ID NO: 19618 - protein, 16 aa, Drosophila melanogaster
DGGLELGDKSGLTGIK

SEQ ID NO: 19619 - protein, 16 aa, Drosophila melanogaster
DGGLELGDKSGLTGIK

SEQ ID NO: 19620 - protein, 29 aa, Drosophila melanogaster
SGLTGIKTEALENGAAGGLSSGVSQFGLK

SEQ ID NO: 19621 - protein, 8 aa, Drosophila melanogaster
TLLDLDKK

SEQ ID NO: 19622 - protein, 9 aa, Drosophila melanogaster
SKDNTKSDK

SEQ ID NO: 19623 - protein, 11 aa, Drosophila melanogaster
KKPAASSGGGK

SEQ ID NO: 19624 - protein, 12 aa, Drosophila melanogaster
LGKNSADPPATR

SEQ ID NO: 19625 - protein, 10 aa, Drosophila melanogaster
AKHLAALEER

SEQ ID NO: 19626 - protein, 10 aa, Drosophila melanogaster
AKHLAALEER

SEQ ID NO: 19627 - protein, 10 aa, Drosophila melanogaster
AKHLAALEER

SEQ ID NO: 19628 - protein, 10 aa, Drosophila melanogaster
AKHLAALEER

SEQ ID NO: 19629 - protein, 10 aa, Drosophila melanogaster
AKHLAALEER

SEQ ID NO: 19630 - protein, 11 aa, Drosophila melanogaster
FDFSIGKNPTR

SEQ ID NO: 19631 - protein, 12 aa, Drosophila melanogaster
KFDFSIGKNPTR

SEQ ID NO: 19632 - protein, 12 aa, Drosophila melanogaster
KFDFSIGKNPTR

SEQ ID NO: 19633 - protein, 21 aa, Drosophila melanogaster
SNKSSPTETAAAASGGEVDIK

SEQ ID NO: 19634 - protein, 21 aa, Drosophila melanogaster
SNKSSPTETAAAASGGEVDIK

SEQ ID NO: 19635 - protein, 21 aa, Drosophila melanogaster
SNKSSPTETAAAASGGEVDIK

SEQ ID NO: 19636 - protein, 21 aa, Drosophila melanogaster
SNKSSPTETAAAASGGEVDIK

SEQ ID NO: 19637 - protein, 10 aa, Drosophila melanogaster
AKHLAALEER

SEQ ID NO: 19638 - protein, 10 aa, Drosophila melanogaster
AKHLAALEER

SEQ ID NO: 19639 - protein, 10 aa, Drosophila melanogaster
AKHLAALEER

SEQ ID NO: 19640 - protein, 10 aa, Drosophila melanogaster
AKHLAALEER

SEQ ID NO: 19641 - protein, 10 aa, Drosophila melanogaster
AKHLAALEER

SEQ ID NO: 19642 - protein, 10 aa, Drosophila melanogaster
AKHLAALEER

SEQ ID NO: 19643 - protein, 10 aa, Drosophila melanogaster
AKHLAALEER

SEQ ID NO: 19644 - protein, 10 aa, Drosophila melanogaster
AKHLAALEER

SEQ ID NO: 19645 - protein, 10 aa, Drosophila melanogaster
AKHLAALEER

SEQ ID NO: 19646 - protein, 10 aa, Drosophila melanogaster
AKHLAALEER

SEQ ID NO: 19647 - protein, 10 aa, Drosophila melanogaster
AKHLAALEER

SEQ ID NO: 19648 - protein, 10 aa, Drosophila melanogaster
AKHLAALEER

SEQ ID NO: 19649 - protein, 10 aa, Drosophila melanogaster
AKHLAALEER

SEQ ID NO: 19650 - protein, 10 aa, Drosophila melanogaster
AKHLAALEER

SEQ ID NO: 19651 - protein, 10 aa, Drosophila melanogaster
AKHLAALEER

SEQ ID NO: 19652 - protein, 10 aa, Drosophila melanogaster
AKHLAALEER

SEQ ID NO: 19653 - protein, 10 aa, Drosophila melanogaster
AKHLAALEER

SEQ ID NO: 19654 - protein, 10 aa, Drosophila melanogaster
AKHLAALEER

SEQ ID NO: 19655 - protein, 10 aa, Drosophila melanogaster
AKHLAALEER

SEQ ID NO: 19656 - protein, 10 aa, Drosophila melanogaster
DLSKKDDDAK

SEQ ID NO: 19657 - protein, 41 aa, Drosophila melanogaster
FNPNFGLANSGIAGTGNDKDDEEGKEGGASASAGGSDEEMK

SEQ ID NO: 19658 - protein, 6 aa, Drosophila melanogaster
KPAAMR

SEQ ID NO: 19659 - protein, 7 aa, Drosophila melanogaster
AKDDIKR

SEQ ID NO: 19660 - protein, 7 aa, Drosophila melanogaster
AKDDIKR

SEQ ID NO: 19661 - protein, 11 aa, Drosophila melanogaster
KKEDEEIHPGR

SEQ ID NO: 19662 - protein, 11 aa, Drosophila melanogaster
KKEDEEIHPGR

SEQ ID NO: 19663 - protein, 11 aa, Drosophila melanogaster
KKEDEEIHPGR

SEQ ID NO: 19664 - protein, 11 aa, Drosophila melanogaster
KKEDEEIHPGR

SEQ ID NO: 19665 - protein, 11 aa, Drosophila melanogaster
KKEDEEIHPGR

SEQ ID NO: 19666 - protein, 10 aa, Drosophila melanogaster
SEEEIEIFKR

SEQ ID NO: 19667 - protein, 11 aa, Drosophila melanogaster
KKEDEEIHPGR

SEQ ID NO: 19668 - protein, 11 aa, Drosophila melanogaster
KKEDEEIHPGR

SEQ ID NO: 19669 - protein, 11 aa, Drosophila melanogaster
KKEDEEIHPGR

SEQ ID NO: 19670 - protein, 11 aa, Drosophila melanogaster
KKEDEEIHPGR

SEQ ID NO: 19671 - protein, 11 aa, Drosophila melanogaster
KKEDEEIHPGR

SEQ ID NO: 19672 - protein, 11 aa, Drosophila melanogaster
KKEDEEIHPGR

SEQ ID NO: 19673 - protein, 11 aa, Drosophila melanogaster
KKEDEEIHPGR

SEQ ID NO: 19674 - protein, 11 aa, Drosophila melanogaster
KKEDEEIHPGR

SEQ ID NO: 19675 - protein, 11 aa, Drosophila melanogaster
KKEDEEIHPGR

SEQ ID NO: 19676 - protein, 11 aa, Drosophila melanogaster
KKEDEEIHPGR

SEQ ID NO: 19677 - protein, 12 aa, Drosophila melanogaster
TLSEPFMKLPSR

SEQ ID NO: 19678 - protein, 5 aa, Drosophila melanogaster
KEQER

SEQ ID NO: 19679 - protein, 8 aa, Drosophila melanogaster
NNKAQLAR

SEQ ID NO: 19680 - protein, 8 aa, Drosophila melanogaster
NNKAQLAR

SEQ ID NO: 19681 - protein, 8 aa, Drosophila melanogaster
NNKAQLAR

SEQ ID NO: 19682 - protein, 8 aa, Drosophila melanogaster
NNKAQLAR

SEQ ID NO: 19683 - protein, 8 aa, Drosophila melanogaster
NNKAQLAR

SEQ ID NO: 19684 - protein, 8 aa, Drosophila melanogaster
NNKAQLAR

SEQ ID NO: 19685 - protein, 5 aa, Drosophila melanogaster
KEQER

SEQ ID NO: 19686 - protein, 8 aa, Drosophila melanogaster
EQKKEQER

SEQ ID NO: 19687 - protein, 8 aa, Drosophila melanogaster
EQKKEQER

SEQ ID NO: 19688 - protein, 5 aa, Drosophila melanogaster
IEKER

SEQ ID NO: 19689 - protein, 5 aa, Drosophila melanogaster
IEKER

SEQ ID NO: 19690 - protein, 8 aa, Drosophila melanogaster
EQKKEQER

SEQ ID NO: 19691 - protein, 10 aa, Drosophila melanogaster
PVDIKKILQR

SEQ ID NO: 19692 - protein, 10 aa, Drosophila melanogaster
PVDIKKILQR

SEQ ID NO: 19693 - protein, 15 aa, Drosophila melanogaster
LDGTTKAEDRGELLR

SEQ ID NO: 19694 - protein, 15 aa, Drosophila melanogaster
LDGTTKAEDRGELLR

SEQ ID NO: 19695 - protein, 10 aa, Drosophila melanogaster
KLKTAVITER

SEQ ID NO: 19696 - protein, 8 aa, Drosophila melanogaster
EQPLELKR

SEQ ID NO: 19697 - protein, 8 aa, Drosophila melanogaster
EQPLELKR

SEQ ID NO: 19698 - protein, 12 aa, Drosophila melanogaster
RGGGSKSQHERR

SEQ ID NO: 19699 - protein, 16 aa, Drosophila melanogaster
RMVESSEAFQEELKRH

SEQ ID NO: 19700 - protein, 16 aa, Drosophila melanogaster
RMVESSEAFQEELKRH

SEQ ID NO: 19701 - protein, 16 aa, Drosophila melanogaster
RMVESSEAFQEELKRH

SEQ ID NO: 19702 - protein, 16 aa, Drosophila melanogaster
RMVESSEAFQEELKRH

SEQ ID NO: 19703 - protein, 16 aa, Drosophila melanogaster
RMVESSEAFQEELKRH

SEQ ID NO: 19704 - protein, 15 aa, Drosophila melanogaster
RHCKPAVDEETFQKM

SEQ ID NO: 19705 - protein, 16 aa, Drosophila melanogaster
RMVESSEAFQEELKRH

SEQ ID NO: 19706 - protein, 16 aa, Drosophila melanogaster
RMVESSEAFQEELKRH

SEQ ID NO: 19707 - protein, 15 aa, Drosophila melanogaster
RHCKPAVDEETFQKM

SEQ ID NO: 19708 - protein, 16 aa, Drosophila melanogaster
RMVESSEAFQEELKRH

SEQ ID NO: 19709 - protein, 15 aa, Drosophila melanogaster
KVKTDVDMHETPSRG

SEQ ID NO: 19710 - protein, 15 aa, Drosophila melanogaster
KVKTDVDMHETPSRG

SEQ ID NO: 19711 - protein, 15 aa, Drosophila melanogaster
KVKTDVDMHETPSRG

SEQ ID NO: 19712 - protein, 15 aa, Drosophila melanogaster
KVKTDVDMHETPSRG

SEQ ID NO: 19713 - protein, 15 aa, Drosophila melanogaster
KVKTDVDMHETPSRG

SEQ ID NO: 19714 - protein, 15 aa, Drosophila melanogaster
KVKTDVDMHETPSRG

SEQ ID NO: 19715 - protein, 12 aa, Drosophila melanogaster
RGGGSKSQHERR

SEQ ID NO: 19716 - protein, 12 aa, Drosophila melanogaster
RGGGSKSQHERR

SEQ ID NO: 19717 - protein, 12 aa, Drosophila melanogaster
RGGGSKSQHERR

SEQ ID NO: 19718 - protein, 12 aa, Drosophila melanogaster
RGGGSKSQHERR

SEQ ID NO: 19719 - protein, 28 aa, Drosophila melanogaster
RRIDIQPAEDEDDQDEGYTTKHLAYARY

SEQ ID NO: 19720 - protein, 12 aa, Drosophila melanogaster
RGGGSKSQHERR

SEQ ID NO: 19721 - protein, 12 aa, Drosophila melanogaster
RGGGSKSQHERR

SEQ ID NO: 19722 - protein, 12 aa, Drosophila melanogaster
RGGGSKSQHERR

SEQ ID NO: 19723 - protein, 12 aa, Drosophila melanogaster
RGGGSKSQHERR

SEQ ID NO: 19724 - protein, 19 aa, Drosophila melanogaster
KAYHQTPAYQAYMSAKSKV

SEQ ID NO: 19725 - protein, 19 aa, Drosophila melanogaster
KAYHQTPAYQAYMSAKSKV

SEQ ID NO: 19726 - protein, 19 aa, Drosophila melanogaster
KAYHQTPAYQAYMSAKSKV

SEQ ID NO: 19727 - protein, 19 aa, Drosophila melanogaster
KAYHQTPAYQAYMSAKSKV

SEQ ID NO: 19728 - protein, 19 aa, Drosophila melanogaster
KAYHQTPAYQAYMSAKSKV

SEQ ID NO: 19729 - protein, 13 aa, Drosophila melanogaster
KSSSSKNQNESRL

SEQ ID NO: 19730 - protein, 13 aa, Drosophila melanogaster
KSSSSKNQNESRL

SEQ ID NO: 19731 - protein, 20 aa, Drosophila melanogaster
RTHTTQETDGFQVKRPGDRN

SEQ ID NO: 19732 - protein, 12 aa, Drosophila melanogaster
KTHKLQDAHERE

SEQ ID NO: 19733 - protein, 16 aa, Drosophila melanogaster
RLLEDGKGDPNTKIKR

SEQ ID NO: 19734 - protein, 10 aa, Drosophila melanogaster
KRKFSSFFKS

SEQ ID NO: 19735 - protein, 12 aa, Drosophila melanogaster
KTHKLQDAHERE

SEQ ID NO: 19736 - protein, 12 aa, Drosophila melanogaster
KTHKLQDAHERE

SEQ ID NO: 19737 - protein, 11 aa, Drosophila melanogaster
RMKFAEIPQRL

SEQ ID NO: 19738 - protein, 18 aa, Drosophila melanogaster
REFFLSFAKDPQMFIHRW

SEQ ID NO: 19739 - protein, 12 aa, Drosophila melanogaster
RKRLDIQEALKR

SEQ ID NO: 19740 - protein, 12 aa, Drosophila melanogaster
RKRLDIQEALKR

SEQ ID NO: 19741 - protein, 12 aa, Drosophila melanogaster
RKRLDIQEALKR

SEQ ID NO: 19742 - protein, 12 aa, Drosophila melanogaster
RKRLDIQEALKR

SEQ ID NO: 19743 - protein, 17 aa, Drosophila melanogaster
KIHETVDTINQMKTNRE

SEQ ID NO: 19744 - protein, 11 aa, Drosophila melanogaster
RYFFTKVNQKR

SEQ ID NO: 19745 - protein, 10 aa, Drosophila melanogaster
RKLDATIMRK

SEQ ID NO: 19746 - protein, 20 aa, Drosophila melanogaster
RTHTTQETDGFQVKRPGDRN

SEQ ID NO: 19747 - protein, 18 aa, Drosophila melanogaster
REFFLSFAKDPQMFIHRW

SEQ ID NO: 19748 - protein, 18 aa, Drosophila melanogaster
REFFLSFAKDPQMFIHRW

SEQ ID NO: 19749 - protein, 18 aa, Drosophila melanogaster
REFFLSFAKDPQMFIHRW

SEQ ID NO: 19750 - protein, 18 aa, Drosophila melanogaster
REFFLSFAKDPQMFIHRW

SEQ ID NO: 19751 - protein, 18 aa, Drosophila melanogaster
REFFLSFAKDPQMFIHRW

SEQ ID NO: 19752 - protein, 18 aa, Drosophila melanogaster
REFFLSFAKDPQMFIHRW

SEQ ID NO: 19753 - protein, 18 aa, Drosophila melanogaster
REFFLSFAKDPQMFIHRW

SEQ ID NO: 19754 - protein, 18 aa, Drosophila melanogaster
REFFLSFAKDPQMFIHRW

SEQ ID NO: 19755 - protein, 18 aa, Drosophila melanogaster
REFFLSFAKDPQMFIHRW

SEQ ID NO: 19756 - protein, 18 aa, Drosophila melanogaster
REFFLSFAKDPQMFIHRW

SEQ ID NO: 19757 - protein, 18 aa, Drosophila melanogaster
REFFLSFAKDPQMFIHRW

SEQ ID NO: 19758 - protein, 18 aa, Drosophila melanogaster
REFFLSFAKDPQMFIHRW

SEQ ID NO: 19759 - protein, 18 aa, Drosophila melanogaster
REFFLSFAKDPQMFIHRW

SEQ ID NO: 19760 - protein, 18 aa, Drosophila melanogaster
REFFLSFAKDPQMFIHRW

SEQ ID NO: 19761 - protein, 18 aa, Drosophila melanogaster
REFFLSFAKDPQMFIHRW

SEQ ID NO: 19762 - protein, 18 aa, Drosophila melanogaster
REFFLSFAKDPQMFIHRW

SEQ ID NO: 19763 - protein, 18 aa, Drosophila melanogaster
REFFLSFAKDPQMFIHRW

SEQ ID NO: 19764 - protein, 18 aa, Drosophila melanogaster
REFFLSFAKDPQMFIHRW

SEQ ID NO: 19765 - protein, 18 aa, Drosophila melanogaster
REFFLSFAKDPQMFIHRW

SEQ ID NO: 19766 - protein, 18 aa, Drosophila melanogaster
REFFLSFAKDPQMFIHRW

SEQ ID NO: 19767 - protein, 18 aa, Drosophila melanogaster
REFFLSFAKDPQMFIHRW

SEQ ID NO: 19768 - protein, 18 aa, Drosophila melanogaster
REFFLSFAKDPQMFIHRW

SEQ ID NO: 19769 - protein, 18 aa, Drosophila melanogaster
REFFLSFAKDPQMFIHRW

SEQ ID NO: 19770 - protein, 18 aa, Drosophila melanogaster
REFFLSFAKDPQMFIHRW

SEQ ID NO: 19771 - protein, 18 aa, Drosophila melanogaster
REFFLSFAKDPQMFIHRW

SEQ ID NO: 19772 - protein, 18 aa, Drosophila melanogaster
REFFLSFAKDPQMFIHRW

SEQ ID NO: 19773 - protein, 18 aa, Drosophila melanogaster
REFFLSFAKDPQMFIHRW

SEQ ID NO: 19774 - protein, 18 aa, Drosophila melanogaster
REFFLSFAKDPQMFIHRW

SEQ ID NO: 19775 - protein, 18 aa, Drosophila melanogaster
REFFLSFAKDPQMFIHRW

SEQ ID NO: 19776 - protein, 18 aa, Drosophila melanogaster
REFFLSFAKDPQMFIHRW

SEQ ID NO: 19777 - protein, 18 aa, Drosophila melanogaster
REFFLSFAKDPQMFIHRW

SEQ ID NO: 19778 - protein, 18 aa, Drosophila melanogaster
REFFLSFAKDPQMFIHRW

SEQ ID NO: 19779 - protein, 18 aa, Drosophila melanogaster
REFFLSFAKDPQMFIHRW

SEQ ID NO: 19780 - protein, 18 aa, Drosophila melanogaster
REFFLSFAKDPQMFIHRW

SEQ ID NO: 19781 - protein, 18 aa, Drosophila melanogaster
REFFLSFAKDPQMFIHRW

SEQ ID NO: 19782 - protein, 18 aa, Drosophila melanogaster
REFFLSFAKDPQMFIHRW

SEQ ID NO: 19783 - protein, 18 aa, Drosophila melanogaster
REFFLSFAKDPQMFIHRW

SEQ ID NO: 19784 - protein, 18 aa, Drosophila melanogaster
REFFLSFAKDPQMFIHRW

SEQ ID NO: 19785 - protein, 18 aa, Drosophila melanogaster
REFFLSFAKDPQMFIHRW

SEQ ID NO: 19786 - protein, 18 aa, Drosophila melanogaster
REFFLSFAKDPQMFIHRW

SEQ ID NO: 19787 - protein, 18 aa, Drosophila melanogaster
REFFLSFAKDPQMFIHRW

SEQ ID NO: 19788 - protein, 18 aa, Drosophila melanogaster
REFFLSFAKDPQMFIHRW

SEQ ID NO: 19789 - protein, 18 aa, Drosophila melanogaster
REFFLSFAKDPQMFIHRW

SEQ ID NO: 19790 - protein, 18 aa, Drosophila melanogaster
REFFLSFAKDPQMFIHRW

SEQ ID NO: 19791 - protein, 18 aa, Drosophila melanogaster
REFFLSFAKDPQMFIHRW

SEQ ID NO: 19792 - protein, 18 aa, Drosophila melanogaster
REFFLSFAKDPQMFIHRW

SEQ ID NO: 19793 - protein, 18 aa, Drosophila melanogaster
REFFLSFAKDPQMFIHRW

SEQ ID NO: 19794 - protein, 18 aa, Drosophila melanogaster
REFFLSFAKDPQMFIHRW

SEQ ID NO: 19795 - protein, 18 aa, Drosophila melanogaster
REFFLSFAKDPQMFIHRW

SEQ ID NO: 19796 - protein, 18 aa, Drosophila melanogaster
REFFLSFAKDPQMFIHRW

SEQ ID NO: 19797 - protein, 18 aa, Drosophila melanogaster
REFFLSFAKDPQMFIHRW

SEQ ID NO: 19798 - protein, 18 aa, Drosophila melanogaster
REFFLSFAKDPQMFIHRW

SEQ ID NO: 19799 - protein, 18 aa, Drosophila melanogaster
REFFLSFAKDPQMFIHRW

SEQ ID NO: 19800 - protein, 18 aa, Drosophila melanogaster
REFFLSFAKDPQMFIHRW

SEQ ID NO: 19801 - protein, 18 aa, Drosophila melanogaster
REFFLSFAKDPQMFIHRW

SEQ ID NO: 19802 - protein, 18 aa, Drosophila melanogaster
REFFLSFAKDPQMFIHRW

SEQ ID NO: 19803 - protein, 18 aa, Drosophila melanogaster
REFFLSFAKDPQMFIHRW

SEQ ID NO: 19804 - protein, 18 aa, Drosophila melanogaster
REFFLSFAKDPQMFIHRW

SEQ ID NO: 19805 - protein, 18 aa, Drosophila melanogaster
REFFLSFAKDPQMFIHRW

SEQ ID NO: 19806 - protein, 18 aa, Drosophila melanogaster
REFFLSFAKDPQMFIHRW

SEQ ID NO: 19807 - protein, 18 aa, Drosophila melanogaster
REFFLSFAKDPQMFIHRW

SEQ ID NO: 19808 - protein, 18 aa, Drosophila melanogaster
REFFLSFAKDPQMFIHRW

SEQ ID NO: 19809 - protein, 18 aa, Drosophila melanogaster
REFFLSFAKDPQMFIHRW

SEQ ID NO: 19810 - protein, 18 aa, Drosophila melanogaster
REFFLSFAKDPQMFIHRW

SEQ ID NO: 19811 - protein, 18 aa, Drosophila melanogaster
REFFLSFAKDPQMFIHRW

SEQ ID NO: 19812 - protein, 18 aa, Drosophila melanogaster
REFFLSFAKDPQMFIHRW

SEQ ID NO: 19813 - protein, 18 aa, Drosophila melanogaster
REFFLSFAKDPQMFIHRW

SEQ ID NO: 19814 - protein, 18 aa, Drosophila melanogaster
REFFLSFAKDPQMFIHRW

SEQ ID NO: 19815 - protein, 18 aa, Drosophila melanogaster
REFFLSFAKDPQMFIHRW

SEQ ID NO: 19816 - protein, 18 aa, Drosophila melanogaster
REFFLSFAKDPQMFIHRW

SEQ ID NO: 19817 - protein, 18 aa, Drosophila melanogaster
REFFLSFAKDPQMFIHRW

SEQ ID NO: 19818 - protein, 18 aa, Drosophila melanogaster
REFFLSFAKDPQMFIHRW

SEQ ID NO: 19819 - protein, 18 aa, Drosophila melanogaster
REFFLSFAKDPQMFIHRW

SEQ ID NO: 19820 - protein, 18 aa, Drosophila melanogaster
REFFLSFAKDPQMFIHRW

SEQ ID NO: 19821 - protein, 17 aa, Drosophila melanogaster
KIHETVDTINQMKTNRE

SEQ ID NO: 19822 - protein, 17 aa, Drosophila melanogaster
KIHETVDTINQMKTNRE

SEQ ID NO: 19823 - protein, 17 aa, Drosophila melanogaster
KIHETVDTINQMKTNRE

SEQ ID NO: 19824 - protein, 17 aa, Drosophila melanogaster
KIHETVDTINQMKTNRE

SEQ ID NO: 19825 - protein, 19 aa, Drosophila melanogaster
RDLKLMTDVAGNPEEERRA

SEQ ID NO: 19826 - protein, 9 aa, Drosophila melanogaster
RKFSSFFKS

SEQ ID NO: 19827 - protein, 9 aa, Drosophila melanogaster
RKFSSFFKS

SEQ ID NO: 19828 - protein, 16 aa, Drosophila melanogaster
RLLEDGKGDPNTKIKR

SEQ ID NO: 19829 - protein, 10 aa, Drosophila melanogaster
KRKFSSFFKS

SEQ ID NO: 19830 - protein, 10 aa, Drosophila melanogaster
KRKFSSFFKS

SEQ ID NO: 19831 - protein, 9 aa, Drosophila melanogaster
RKFSSFFKS

SEQ ID NO: 19832 - protein, 16 aa, Drosophila melanogaster
RLLEDGKGDPNTKIKR

SEQ ID NO: 19833 - protein, 10 aa, Drosophila melanogaster
KRKFSSFFKS

SEQ ID NO: 19834 - protein, 9 aa, Drosophila melanogaster
RKFSSFFKS

SEQ ID NO: 19835 - protein, 9 aa, Drosophila melanogaster
RKFSSFFKS

SEQ ID NO: 19836 - protein, 9 aa, Drosophila melanogaster
RKFSSFFKS

SEQ ID NO: 19837 - protein, 19 aa, Drosophila melanogaster
REYINCDKYLEQIFSCQRM

SEQ ID NO: 19838 - protein, 19 aa, Drosophila melanogaster
REYINCDKYLEQIFSCQRM

SEQ ID NO: 19839 - protein, 19 aa, Drosophila melanogaster
REYINCDKYLEQIFSCQRM

SEQ ID NO: 19840 - protein, 19 aa, Drosophila melanogaster
REYINCDKYLEQIFSCQRM

SEQ ID NO: 19841 - protein, 19 aa, Drosophila melanogaster
REYINCDKYLEQIFSCQRM

SEQ ID NO: 19842 - protein, 19 aa, Drosophila melanogaster
REYINCDKYLEQIFSCQRM

SEQ ID NO: 19843 - protein, 19 aa, Drosophila melanogaster
REYINCDKYLEQIFSCQRM

SEQ ID NO: 19844 - protein, 19 aa, Drosophila melanogaster
REYINCDKYLEQIFSCQRM

SEQ ID NO: 19845 - protein, 19 aa, Drosophila melanogaster
REYINCDKYLEQIFSCQRM

SEQ ID NO: 19846 - protein, 19 aa, Drosophila melanogaster
REYINCDKYLEQIFSCQRM

SEQ ID NO: 19847 - protein, 19 aa, Drosophila melanogaster
RDLKLMTDVAGNPEEERRA

SEQ ID NO: 19848 - protein, 19 aa, Drosophila melanogaster
RDLKLMTDVAGNPEEERRA

SEQ ID NO: 19849 - protein, 18 aa, Drosophila melanogaster
RDLKLMTDVAGNPEEERR

SEQ ID NO: 19850 - protein, 19 aa, Drosophila melanogaster
RDLKLMTDVAGNPEEERRA

SEQ ID NO: 19851 - protein, 11 aa, Drosophila melanogaster
RYFFTKVNQKR

SEQ ID NO: 19852 - protein, 19 aa, Drosophila melanogaster
RDLKLMTDVAGNPEEERRA

SEQ ID NO: 19853 - protein, 9 aa, Drosophila melanogaster
RKFSSFFKS

SEQ ID NO: 19854 - protein, 19 aa, Drosophila melanogaster
RGTGAGGGGVGSGGGSKRS

SEQ ID NO: 19855 - protein, 19 aa, Drosophila melanogaster
RGTGAGGGGVGSGGGSKRS

SEQ ID NO: 19856 - protein, 19 aa, Drosophila melanogaster
RGTGAGGGGVGSGGGSKRS

SEQ ID NO: 19857 - protein, 14 aa, Drosophila melanogaster
RLLEDGKGDPNTKI

SEQ ID NO: 19858 - protein, 19 aa, Drosophila melanogaster
RGTGAGGGGVGSGGGSKRS

SEQ ID NO: 19859 - protein, 19 aa, Drosophila melanogaster
RGTGAGGGGVGSGGGSKRS

SEQ ID NO: 19860 - protein, 10 aa, Drosophila melanogaster
RKLDATIMRK

SEQ ID NO: 19861 - protein, 18 aa, Drosophila melanogaster
REFFLSFAKDPQMFIHRW

SEQ ID NO: 19862 - protein, 17 aa, Drosophila melanogaster
KIHETVDTINQMKTNRE

SEQ ID NO: 19863 - protein, 19 aa, Drosophila melanogaster
RGTGAGGGGVGSGGGSKRS

SEQ ID NO: 19864 - protein, 17 aa, Drosophila melanogaster
KIHETVDTINQMKTNRE

SEQ ID NO: 19865 - protein, 17 aa, Drosophila melanogaster
KIHETVDTINQMKTNRE

SEQ ID NO: 19866 - protein, 17 aa, Drosophila melanogaster
KIHETVDTINQMKTNRE

SEQ ID NO: 19867 - protein, 19 aa, Drosophila melanogaster
RGTGAGGGGVGSGGGSKRS

SEQ ID NO: 19868 - protein, 11 aa, Drosophila melanogaster
RYFFTKVNQKR

SEQ ID NO: 19869 - protein, 18 aa, Drosophila melanogaster
RDLKLMTDVAGNPEEERR

SEQ ID NO: 19870 - protein, 19 aa, Drosophila melanogaster
RGTGAGGGGVGSGGGSKRS

SEQ ID NO: 19871 - protein, 11 aa, Drosophila melanogaster
RMKFAEIPQRL

SEQ ID NO: 19872 - protein, 11 aa, Drosophila melanogaster
RMKFAEIPQRL

SEQ ID NO: 19873 - protein, 11 aa, Drosophila melanogaster
RMKFAEIPQRL

SEQ ID NO: 19874 - protein, 19 aa, Drosophila melanogaster
RGTGAGGGGVGSGGGSKRS

SEQ ID NO: 19875 - protein, 19 aa, Drosophila melanogaster
RGTGAGGGGVGSGGGSKRS

SEQ ID NO: 19876 - protein, 19 aa, Drosophila melanogaster
RGTGAGGGGVGSGGGSKRS

SEQ ID NO: 19877 - protein, 19 aa, Drosophila melanogaster
RGTGAGGGGVGSGGGSKRS

SEQ ID NO: 19878 - protein, 19 aa, Drosophila melanogaster
RGTGAGGGGVGSGGGSKRS

SEQ ID NO: 19879 - protein, 19 aa, Drosophila melanogaster
RGTGAGGGGVGSGGGSKRS

SEQ ID NO: 19880 - protein, 19 aa, Drosophila melanogaster
RGTGAGGGGVGSGGGSKRS

SEQ ID NO: 19881 - protein, 10 aa, Drosophila melanogaster
KSDFATAKKK

SEQ ID NO: 19882 - protein, 12 aa, Drosophila melanogaster
KTHKLQDAHERE

SEQ ID NO: 19883 - protein, 12 aa, Drosophila melanogaster
KTHKLQDAHERE

SEQ ID NO: 19884 - protein, 12 aa, Drosophila melanogaster
KTHKLQDAHERE

SEQ ID NO: 19885 - protein, 14 aa, Drosophila melanogaster
RLDIQEALKRPMKQ

SEQ ID NO: 19886 - protein, 14 aa, Drosophila melanogaster
RLDIQEALKRPMKQ

SEQ ID NO: 19887 - protein, 17 aa, Drosophila melanogaster
KIHETVDTINQMKTNRE

SEQ ID NO: 19888 - protein, 14 aa, Drosophila melanogaster
RLDIQEALKRPMKQ

SEQ ID NO: 19889 - protein, 14 aa, Drosophila melanogaster
RLDIQEALKRPMKQ

SEQ ID NO: 19890 - protein, 9 aa, Drosophila melanogaster
RKFSSFFKS

SEQ ID NO: 19891 - protein, 9 aa, Drosophila melanogaster
RKFSSFFKS

SEQ ID NO: 19892 - protein, 14 aa, Drosophila melanogaster
RLLEDGKGDPNTKI

SEQ ID NO: 19893 - protein, 6 aa, Drosophila melanogaster
KRKLRI

SEQ ID NO: 19894 - protein, 6 aa, Drosophila melanogaster
KRKLRI

SEQ ID NO: 19895 - protein, 18 aa, Drosophila melanogaster
REFFLSFAKDPQMFIHRW

SEQ ID NO: 19896 - protein, 18 aa, Drosophila melanogaster
REFFLSFAKDPQMFIHRW

SEQ ID NO: 19897 - protein, 18 aa, Drosophila melanogaster
REFFLSFAKDPQMFIHRW

SEQ ID NO: 19898 - protein, 18 aa, Drosophila melanogaster
REFFLSFAKDPQMFIHRW

SEQ ID NO: 19899 - protein, 30 aa, Drosophila melanogaster; identical to SEQ ID NO: 19112

SEQ ID NO: 19900 - protein, 20 aa, Drosophila melanogaster
RTHTTQETDGFQVKRPGDRN

SEQ ID NO: 19901 - protein, 20 aa, Drosophila melanogaster
RTHTTQETDGFQVKRPGDRN

SEQ ID NO: 19902 - protein, 20 aa, Drosophila melanogaster
RTHTTQETDGFQVKRPGDRN

SEQ ID NO: 19903 - protein, 20 aa, Drosophila melanogaster
RTHTTQETDGFQVKRPGDRN

SEQ ID NO: 19904 - protein, 20 aa, Drosophila melanogaster
RTHTTQETDGFQVKRPGDRN

SEQ ID NO: 19905 - protein, 20 aa, Drosophila melanogaster
RTHTTQETDGFQVKRPGDRN

SEQ ID NO: 19906 - protein, 20 aa, Drosophila melanogaster
RTHTTQETDGFQVKRPGDRN

SEQ ID NO: 19907 - protein, 20 aa, Drosophila melanogaster
RTHTTQETDGFQVKRPGDRN

SEQ ID NO: 19908 - protein, 20 aa, Drosophila melanogaster
RTHTTQETDGFQVKRPGDRN

SEQ ID NO: 19909 - protein, 16 aa, Drosophila melanogaster
RTHTTQETDGFQVKRP

SEQ ID NO: 19910 - protein, 20 aa, Drosophila melanogaster
RTHTTQETDGFQVKRPGDRN

SEQ ID NO: 19911 - protein, 20 aa, Drosophila melanogaster
RTHTTQETDGFQVKRPGDRN

SEQ ID NO: 19912 - protein, 20 aa, Drosophila melanogaster
RTHTTQETDGFQVKRPGDRN

SEQ ID NO: 19913 - protein, 20 aa, Drosophila melanogaster
RTHTTQETDGFQVKRPGDRN

SEQ ID NO: 19914 - protein, 20 aa, Drosophila melanogaster
RTHTTQETDGFQVKRPGDRN

SEQ ID NO: 19915 - protein, 20 aa, Drosophila melanogaster
RTHTTQETDGFQVKRPGDRN

SEQ ID NO: 19916 - protein, 11 aa, Drosophila melanogaster
RMKFAEIPQRL

SEQ ID NO: 19917 - protein, 17 aa, Drosophila melanogaster
KIHETVDTINQMKTNRE

SEQ ID NO: 19918 - protein, 17 aa, Drosophila melanogaster
KIHETVDTINQMKTNRE

SEQ ID NO: 19919 - protein, 18 aa, Drosophila melanogaster
REFFLSFAKDPQMFIHRW

SEQ ID NO: 19920 - protein, 18 aa, Drosophila melanogaster
REFFLSFAKDPQMFIHRW

SEQ ID NO: 19921 - protein, 18 aa, Drosophila melanogaster
REFFLSFAKDPQMFIHRW

SEQ ID NO: 19922 - protein, 18 aa, Drosophila melanogaster
REFFLSFAKDPQMFIHRW

SEQ ID NO: 19923 - protein, 18 aa, Drosophila melanogaster
REFFLSFAKDPQMFIHRW

SEQ ID NO: 19924 - protein, 17 aa, Drosophila melanogaster
KIHETVDTINQMKTNRE

SEQ ID NO: 19925 - protein, 17 aa, Drosophila melanogaster
KIHETVDTINQMKTNRE

SEQ ID NO: 19926 - protein, 17 aa, Drosophila melanogaster
KIHETVDTINQMKTNRE

SEQ ID NO: 19927 - protein, 12 aa, Drosophila melanogaster
KTHKLQDAHERE

SEQ ID NO: 19928 - protein, 12 aa, Drosophila melanogaster
KTHKLQDAHERE

SEQ ID NO: 19929 - protein, 12 aa, Drosophila melanogaster
KTHKLQDAHERE

SEQ ID NO: 19930 - protein, 12 aa, Drosophila melanogaster
KTHKLQDAHERE

SEQ ID NO: 19931 - protein, 12 aa, Drosophila melanogaster
KTHKLQDAHERE

SEQ ID NO: 19932 - protein, 12 aa, Drosophila melanogaster
KTHKLQDAHERE

SEQ ID NO: 19933 - protein, 12 aa, Drosophila melanogaster
KTHKLQDAHERE

SEQ ID NO: 19934 - protein, 12 aa, Drosophila melanogaster
KTHKLQDAHERE

SEQ ID NO: 19935 - protein, 17 aa, Drosophila melanogaster
KIHETVDTINQMKTNRE

SEQ ID NO: 19936 - protein, 15 aa, Drosophila melanogaster
RKFYVDTNYVTVPRS

SEQ ID NO: 19937 - protein, 15 aa, Drosophila melanogaster
RKFYVDTNYVTVPRS

SEQ ID NO: 19938 - protein, 8 aa, Drosophila melanogaster
RKGGGNRR

SEQ ID NO: 19939 - protein, 8 aa, Drosophila melanogaster
RKGGGNRR

SEQ ID NO: 19940 - protein, 8 aa, Drosophila melanogaster
RKGGGNRR

SEQ ID NO: 19941 - protein, 12 aa, Drosophila melanogaster
RKNAVEGESDRK

SEQ ID NO: 19942 - protein, 13 aa, Drosophila melanogaster
RLDMELEGQKLRD

SEQ ID NO: 19943 - protein, 13 aa, Drosophila melanogaster
RLDMELEGQKLRD

SEQ ID NO: 19944 - protein, 9 aa, Drosophila melanogaster
KKIRDQDRN

SEQ ID NO: 19945 - protein, 9 aa, Drosophila melanogaster
KKIRDQDRN

SEQ ID NO: 19946 - protein, 9 aa, Drosophila melanogaster
KKIRDQDRN

SEQ ID NO: 19947 - protein, 7 aa, Drosophila melanogaster
RKPEIKT

SEQ ID NO: 19948 - protein, 16 aa, Drosophila melanogaster
RQQFHLEQLKAAEFRA

SEQ ID NO: 19949 - protein, 16 aa, Drosophila melanogaster
RQQFHLEQLKAAEFRA

SEQ ID NO: 19950 - protein, 8 aa, Drosophila melanogaster
KSDKSNKS

SEQ ID NO: 19951 - protein, 8 aa, Drosophila melanogaster
KSDKSNKS

SEQ ID NO: 19952 - protein, 8 aa, Drosophila melanogaster
KSDKSNKS

SEQ ID NO: 19953 - protein, 16 aa, Drosophila melanogaster
RMSIDDIMSFGDEKKK

SEQ ID NO: 19954 - protein, 16 aa, Drosophila melanogaster
RMSIDDIMSFGDEKKK

SEQ ID NO: 19955 - protein, 16 aa, Drosophila melanogaster
RMSIDDIMSFGDEKKK

SEQ ID NO: 19956 - protein, 16 aa, Drosophila melanogaster
RMSIDDIMSFGDEKKK

SEQ ID NO: 19957 - protein, 16 aa, Drosophila melanogaster
RMSIDDIMSFGDEKKK

SEQ ID NO: 19958 - protein, 16 aa, Drosophila melanogaster
RMSIDDIMSFGDEKKK

SEQ ID NO: 19959 - protein, 14 aa, Drosophila melanogaster
KLGKNSADPPATRI

SEQ ID NO: 19960 - protein, 14 aa, Drosophila melanogaster
KLGKNSADPPATRI

SEQ ID NO: 19961 - protein, 14 aa, Drosophila melanogaster
KLGKNSADPPATRI

SEQ ID NO: 19962 - protein, 14 aa, Drosophila melanogaster
KLGKNSADPPATRI

SEQ ID NO: 19963 - protein, 14 aa, Drosophila melanogaster
KLGKNSADPPATRI

SEQ ID NO: 19964 - protein, 14 aa, Drosophila melanogaster
KLGKNSADPPATRI

SEQ ID NO: 19965 - protein, 13 aa, Drosophila melanogaster
KSKTPEIYMAYRN

SEQ ID NO: 19966 - protein, 13 aa, Drosophila melanogaster
KSKTPEIYMAYRN

SEQ ID NO: 19967 - protein, 13 aa, Drosophila melanogaster
KSKTPEIYMAYRN

SEQ ID NO: 19968 - protein, 13 aa, Drosophila melanogaster
KSKTPEIYMAYRN

SEQ ID NO: 19969 - protein, 14 aa, Drosophila melanogaster
KTLLDLDKKPLGKD

SEQ ID NO: 19970 - protein, 14 aa, Drosophila melanogaster
KTLLDLDKKPLGKD

SEQ ID NO: 19971 - protein, 14 aa, Drosophila melanogaster
KTLLDLDKKPLGKD

SEQ ID NO: 19972 - protein, 14 aa, Drosophila melanogaster
KTLLDLDKKPLGKD

SEQ ID NO: 19973 - protein, 14 aa, Drosophila melanogaster
KTLLDLDKKPLGKD

SEQ ID NO: 19974 - protein, 9 aa, Drosophila melanogaster
KGFEGKLRE

SEQ ID NO: 19975 - protein, 9 aa, Drosophila melanogaster
KGFEGKLRE

SEQ ID NO: 19976 - protein, 8 aa, Drosophila melanogaster
KKTHKQRM

SEQ ID NO: 19977 - protein, 9 aa, Drosophila melanogaster
KGFEGKLRE

SEQ ID NO: 19978 - protein, 9 aa, Drosophila melanogaster
KDNTKSDKT

SEQ ID NO: 19979 - protein, 9 aa, Drosophila melanogaster
KDNTKSDKT

SEQ ID NO: 19980 - protein, 32 aa, Drosophila melanogaster
RVAAAAAKAAMEEFAAIKDEVPATIMDNHLKN

SEQ ID NO: 19981 - protein, 32 aa, Drosophila melanogaster; identical to SEQ ID NO: 19980

SEQ ID NO: 19982 - protein, 8 aa, Drosophila melanogaster
KKPAAMRN

SEQ ID NO: 19983 - protein, 8 aa, Drosophila melanogaster
KKPAAMRN

SEQ ID NO: 19984 - protein, 8 aa, Drosophila melanogaster
KKPAAMRN

SEQ ID NO: 19985 - protein, 8 aa, Drosophila melanogaster
KKPAAMRN

SEQ ID NO: 19986 - protein, 7 aa, Drosophila melanogaster
KTHKQRM

SEQ ID NO: 19987 - protein, 7 aa, Drosophila melanogaster
KTHKQRM

SEQ ID NO: 19988 - protein, 7 aa, Drosophila melanogaster
KTHKQRM

SEQ ID NO: 19989 - protein, 12 aa, Drosophila melanogaster
KKPAASSGGGKQ

SEQ ID NO: 19990 - protein, 12 aa, Drosophila melanogaster
KKPAASSGGGKQ

SEQ ID NO: 19991 - protein, 7 aa, Drosophila melanogaster
KTHKQRM

SEQ ID NO: 19992 - protein, 7 aa, Drosophila melanogaster
KTHKQRM

SEQ ID NO: 19993 - protein, 7 aa, Drosophila melanogaster
KTHKQRM

SEQ ID NO: 19994 - protein, 7 aa, Drosophila melanogaster
KTHKQRM

SEQ ID NO: 19995 - protein, 7 aa, Drosophila melanogaster
KTHKQRM

SEQ ID NO: 19996 - protein, 7 aa, Drosophila melanogaster
KTHKQRM

SEQ ID NO: 19997 - protein, 7 aa, Drosophila melanogaster
KTHKQRM

SEQ ID NO: 19998 - protein, 14 aa, Drosophila melanogaster
KLDQYAKKPAAMRN

SEQ ID NO: 19999 - protein, 20 aa, Drosophila melanogaster
KANAALQSTASPAPGGKSRG

SEQ ID NO: 20000 - protein, 20 aa, Drosophila melanogaster
KANAALQSTASPAPGGKSRG

SEQ ID NO: 20001 - protein, 20 aa, Drosophila melanogaster
KANAALQSTASPAPGGKSRG

SEQ ID NO: 20002 - protein, 7 aa, Drosophila melanogaster
KTHKQRM

SEQ ID NO: 20003 - protein, 7 aa, Drosophila melanogaster
KTHKQRM

SEQ ID NO: 20004 - protein, 6 aa, Drosophila melanogaster
IKTHKL

SEQ ID NO: 20005 - protein, 14 aa, Drosophila melanogaster
KTLLDLDKKPLGKD

SEQ ID NO: 20006 - protein, 14 aa, Drosophila melanogaster
KTLLDLDKKPLGKD

SEQ ID NO: 20007 - protein, 10 aa, Drosophila melanogaster
KTLLDLDKKP

SEQ ID NO: 20008 - protein, 10 aa, Drosophila melanogaster
KTLLDLDKKP

SEQ ID NO: 20009 - protein, 10 aa, Drosophila melanogaster
KTLLDLDKKP

SEQ ID NO: 20010 - protein, 10 aa, Drosophila melanogaster
KTLLDLDKKP

SEQ ID NO: 20011 - protein, 10 aa, Drosophila melanogaster
KTLLDLDKKP

SEQ ID NO: 20012 - protein, 14 aa, Drosophila melanogaster
KTLLDLDKKPLGKD

SEQ ID NO: 20013 - protein, 14 aa, Drosophila melanogaster
KTLLDLDKKPLGKD

SEQ ID NO: 20014 - protein, 14 aa, Drosophila melanogaster
KTLLDLDKKPLGKD

SEQ ID NO: 20015 - protein, 16 aa, Drosophila melanogaster
KKPLGKDGGLELGDKS

SEQ ID NO: 20016 - protein, 8 aa, Drosophila melanogaster
KKDDDAKS

SEQ ID NO: 20017 - protein, 6 aa, Drosophila melanogaster
IKTHKL

SEQ ID NO: 20018 - protein, 6 aa, Drosophila melanogaster
IKTHKL

SEQ ID NO: 20019 - protein, 17 aa, Drosophila melanogaster
RKIKSLVALLVETQMKK

SEQ ID NO: 20020 - protein, 12 aa, Drosophila melanogaster
KAKHLAALEERK

SEQ ID NO: 20021 - protein, 12 aa, Drosophila melanogaster
KAKHLAALEERK

SEQ ID NO: 20022 - protein, 12 aa, Drosophila melanogaster
KAKHLAALEERK

SEQ ID NO: 20023 - protein, 7 aa, Drosophila melanogaster
KKLEIKL

SEQ ID NO: 20024 - protein, 9 aa, Drosophila melanogaster
KGFEGKLRE

SEQ ID NO: 20025 - protein, 9 aa, Drosophila melanogaster
KGFEGKLRE

SEQ ID NO: 20026 - protein, 9 aa, Drosophila melanogaster
KGFEGKLRE

SEQ ID NO: 20027 - protein, 9 aa, Drosophila melanogaster
KSAIKSDKS

SEQ ID NO: 20028 - protein, 9 aa, Drosophila melanogaster
KSAIKSDKS

SEQ ID NO: 20029 - protein, 9 aa, Drosophila melanogaster
KSAIKSDKS

SEQ ID NO: 20030 - protein, 9 aa, Drosophila melanogaster
KSAIKSDKS

SEQ ID NO: 20031 - protein, 25 aa, Drosophila melanogaster
KAAMEEFAAIKDEVPATIMDNHLKN

SEQ ID NO: 20032 - protein, 25 aa, Drosophila melanogaster
KAAMEEFAAIKDEVPATIMDNHLKN

SEQ ID NO: 20033 - protein, 25 aa, Drosophila melanogaster
KAAMEEFAAIKDEVPATIMDNHLKN

SEQ ID NO: 20034 - protein, 25 aa, Drosophila melanogaster
KAAMEEFAAIKDEVPATIMDNHLKN

SEQ ID NO: 20035 - protein, 25 aa, Drosophila melanogaster
KAAMEEFAAIKDEVPATIMDNHLKN

SEQ ID NO: 20036 - protein, 25 aa, Drosophila melanogaster
KAAMEEFAAIKDEVPATIMDNHLKN

SEQ ID NO: 20037 - protein, 25 aa, Drosophila melanogaster
KAAMEEFAAIKDEVPATIMDNHLKN

SEQ ID NO: 20038 - protein, 25 aa, Drosophila melanogaster
KAAMEEFAAIKDEVPATIMDNHLKN

SEQ ID NO: 20039 - protein, 25 aa, Drosophila melanogaster
KAAMEEFAAIKDEVPATIMDNHLKN

SEQ ID NO: 20040 - protein, 25 aa, Drosophila melanogaster
KAAMEEFAAIKDEVPATIMDNHLKN

SEQ ID NO: 20041 - protein, 25 aa, Drosophila melanogaster
KAAMEEFAAIKDEVPATIMDNHLKN

SEQ ID NO: 20042 - protein, 25 aa, Drosophila melanogaster
KAAMEEFAAIKDEVPATIMDNHLKN

SEQ ID NO: 20043 - protein, 25 aa, Drosophila melanogaster
KAAMEEFAAIKDEVPATIMDNHLKN

SEQ ID NO: 20044 - protein, 25 aa, Drosophila melanogaster
KAAMEEFAAIKDEVPATIMDNHLKN

SEQ ID NO: 20045 - protein, 25 aa, Drosophila melanogaster
KAAMEEFAAIKDEVPATIMDNHLKN

SEQ ID NO: 20046 - protein, 25 aa, Drosophila melanogaster
KAAMEEFAAIKDEVPATIMDNHLKN

SEQ ID NO: 20047 - protein, 25 aa, Drosophila melanogaster
KAAMEEFAAIKDEVPATIMDNHLKN

SEQ ID NO: 20048 - protein, 25 aa, Drosophila melanogaster
KAAMEEFAAIKDEVPATIMDNHLKN

SEQ ID NO: 20049 - protein, 25 aa, Drosophila melanogaster
KAAMEEFAAIKDEVPATIMDNHLKN

SEQ ID NO: 20050 - protein, 8 aa, Drosophila melanogaster
KSKDNTKS

SEQ ID NO: 20051 - protein, 12 aa, Drosophila melanogaster
KDLSKKDDDAKS

SEQ ID NO: 20052 - protein, 12 aa, Drosophila melanogaster
KAKHLAALEERK

SEQ ID NO: 20053 - protein, 11 aa, Drosophila melanogaster
RVMQAVDKVRH

SEQ ID NO: 20054 - protein, 11 aa, Drosophila melanogaster
RVMQAVDKVRH

SEQ ID NO: 20055 - protein, 12 aa, Drosophila melanogaster
RSEEEIEIFKRM

SEQ ID NO: 20056 - protein, 12 aa, Drosophila melanogaster
RSEEEIEIFKRM

SEQ ID NO: 20057 - protein, 12 aa, Drosophila melanogaster
RSEEEIEIFKRM

SEQ ID NO: 20058 - protein, 12 aa, Drosophila melanogaster
RSEEEIEIFKRM

SEQ ID NO: 20059 - protein, 12 aa, Drosophila melanogaster
RSEEEIEIFKRM

SEQ ID NO: 20060 - protein, 13 aa, Drosophila melanogaster
RKKEDEEIHPGRE

SEQ ID NO: 20061 - protein, 12 aa, Drosophila melanogaster
RSEEEIEIFKRM

SEQ ID NO: 20062 - protein, 12 aa, Drosophila melanogaster
RSEEEIEIFKRM

SEQ ID NO: 20063 - protein, 12 aa, Drosophila melanogaster
RSEEEIEIFKRM

SEQ ID NO: 20064 - protein, 12 aa, Drosophila melanogaster
RSEEEIEIFKRM

SEQ ID NO: 20065 - protein, 12 aa, Drosophila melanogaster
RSEEEIEIFKRM

SEQ ID NO: 20066 - protein, 12 aa, Drosophila melanogaster
RSEEEIEIFKRM

SEQ ID NO: 20067 - protein, 12 aa, Drosophila melanogaster
RSEEEIEIFKRM

SEQ ID NO: 20068 - protein, 12 aa, Drosophila melanogaster
RSEEEIEIFKRM

SEQ ID NO: 20069 - protein, 12 aa, Drosophila melanogaster
RSEEEIEIFKRM

SEQ ID NO: 20070 - protein, 12 aa, Drosophila melanogaster
RSEEEIEIFKRM

SEQ ID NO: 20071 - protein, 7 aa, Drosophila melanogaster
KKILQRI

SEQ ID NO: 20072 - protein, 16 aa, Drosophila melanogaster
RMNKAVMNHHANAERE

SEQ ID NO: 20073 - protein, 16 aa, Drosophila melanogaster
RMNKAVMNHHANAERE

SEQ ID NO: 20074 - protein, 16 aa, Drosophila melanogaster
RMNKAVMNHHANAERE

SEQ ID NO: 20075 - protein, 16 aa, Drosophila melanogaster
RMNKAVMNHHANAERE

SEQ ID NO: 20076 - protein, 16 aa, Drosophila melanogaster
RMNKAVMNHHANAERE

SEQ ID NO: 20077 - protein, 16 aa, Drosophila melanogaster
RMNKAVMNHHANAERE

SEQ ID NO: 20078 - protein, 16 aa, Drosophila melanogaster
RMNKAVMNHHANAERE

SEQ ID NO: 20079 - protein, 10 aa, Drosophila melanogaster
REQKKEQERI

SEQ ID NO: 20080 - protein, 7 aa, Drosophila melanogaster
RIEKERM

SEQ ID NO: 20081 - protein, 7 aa, Drosophila melanogaster
RIEKERM

SEQ ID NO: 20082 - protein, 10 aa, Drosophila melanogaster
REQKKEQERI

SEQ ID NO: 20083 - protein, 10 aa, Drosophila melanogaster
REQKKEQERI

SEQ ID NO: 20084 - protein, 7 aa, Drosophila melanogaster
RIEKERM

SEQ ID NO: 20085 - protein, 14 aa, Drosophila melanogaster
RQRLPDYYEIIKRP

SEQ ID NO: 20086 - protein, 14 aa, Drosophila melanogaster
RQRLPDYYEIIKRP

SEQ ID NO: 20087 - protein, 7 aa, Drosophila melanogaster
RKFNAKG

SEQ ID NO: 20088 - protein, 7 aa, Drosophila melanogaster
RKFNAKG

SEQ ID NO: 20089 - protein, 8 aa, Drosophila melanogaster
KYSKVGRK

SEQ ID NO: 20090 - protein, 7 aa, Drosophila melanogaster
RKFLEKE

SEQ ID NO: 20091 - protein, 7 aa, Drosophila melanogaster
RKFLEKE

SEQ ID NO: 20092 - protein, 10 aa, Drosophila melanogaster
GGGSKSQHER

SEQ ID NO: 20093 - protein, 14 aa, Drosophila melanogaster
MVESSEAFQEELKR

SEQ ID NO: 20094 - protein, 14 aa, Drosophila melanogaster
MVESSEAFQEELKR

SEQ ID NO: 20095 - protein, 14 aa, Drosophila melanogaster
MVESSEAFQEELKR

SEQ ID NO: 20096 - protein, 14 aa, Drosophila melanogaster
MVESSEAFQEELKR

SEQ ID NO: 20097 - protein, 14 aa, Drosophila melanogaster
MVESSEAFQEELKR

SEQ ID NO: 20098 - protein, 13 aa, Drosophila melanogaster
HCKPAVDEETFQK

SEQ ID NO: 20099 - protein, 14 aa, Drosophila melanogaster
MVESSEAFQEELKR

SEQ ID NO: 20100 - protein, 14 aa, Drosophila melanogaster
MVESSEAFQEELKR

SEQ ID NO: 20101 - protein, 13 aa, Drosophila melanogaster
HCKPAVDEETFQK

SEQ ID NO: 20102 - protein, 14 aa, Drosophila melanogaster
MVESSEAFQEELKR

SEQ ID NO: 20103 - protein, 13 aa, Drosophila melanogaster
VKTDVDMHETPSR

SEQ ID NO: 20104 - protein, 13 aa, Drosophila melanogaster
VKTDVDMHETPSR

SEQ ID NO: 20105 - protein, 13 aa, Drosophila melanogaster
VKTDVDMHETPSR

SEQ ID NO: 20106 - protein, 13 aa, Drosophila melanogaster
VKTDVDMHETPSR

SEQ ID NO: 20107 - protein, 13 aa, Drosophila melanogaster
VKTDVDMHETPSR

SEQ ID NO: 20108 - protein, 13 aa, Drosophila melanogaster
VKTDVDMHETPSR

SEQ ID NO: 20109 - protein, 10 aa, Drosophila melanogaster
GGGSKSQHER

SEQ ID NO: 20110 - protein, 10 aa, Drosophila melanogaster
GGGSKSQHER

SEQ ID NO: 20111 - protein, 10 aa, Drosophila melanogaster
GGGSKSQHER

SEQ ID NO: 20112 - protein, 10 aa, Drosophila melanogaster
GGGSKSQHER

SEQ ID NO: 20113 - protein, 26 aa, Drosophila melanogaster
RIDIQPAEDEDDQDEGYTTKHLAYAR

SEQ ID NO: 20114 - protein, 10 aa, Drosophila melanogaster
GGGSKSQHER

SEQ ID NO: 20115 - protein, 10 aa, Drosophila melanogaster
GGGSKSQHER

SEQ ID NO: 20116 - protein, 10 aa, Drosophila melanogaster
GGGSKSQHER

SEQ ID NO: 20117 - protein, 10 aa, Drosophila melanogaster
GGGSKSQHER

SEQ ID NO: 20118 - protein, 17 aa, Drosophila melanogaster
AYHQTPAYQAYMSAKSK

SEQ ID NO: 20119 - protein, 17 aa, Drosophila melanogaster
AYHQTPAYQAYMSAKSK

SEQ ID NO: 20120 - protein, 17 aa, Drosophila melanogaster
AYHQTPAYQAYMSAKSK

SEQ ID NO: 20121 - protein, 17 aa, Drosophila melanogaster
AYHQTPAYQAYMSAKSK

SEQ ID NO: 20122 - protein, 17 aa, Drosophila melanogaster
AYHQTPAYQAYMSAKSK

SEQ ID NO: 20123 - protein, 11 aa, Drosophila melanogaster
SSSSKNQNESR

SEQ ID NO: 20124 - protein, 11 aa, Drosophila melanogaster
SSSSKNQNESR

SEQ ID NO: 20125 - protein, 18 aa, Drosophila melanogaster
THTTQETDGFQVKRPGDR

SEQ ID NO: 20126 - protein, 10 aa, Drosophila melanogaster
THKLQDAHER

SEQ ID NO: 20127 - protein, 14 aa, Drosophila melanogaster
LLEDGKGDPNTKIK

SEQ ID NO: 20128 - protein, 8 aa, Drosophila melanogaster
RKFSSFFK

SEQ ID NO: 20129 - protein, 10 aa, Drosophila melanogaster
THKLQDAHER

SEQ ID NO: 20130 - protein, 10 aa, Drosophila melanogaster
THKLQDAHER

SEQ ID NO: 20131 - protein, 9 aa, Drosophila melanogaster
MKFAEIPQR

SEQ ID NO: 20132 - protein, 16 aa, Drosophila melanogaster
EFFLSFAKDPQMFIHR

SEQ ID NO: 20133 - protein, 10 aa, Drosophila melanogaster
KRLDIQEALK

SEQ ID NO: 20134 - protein, 10 aa, Drosophila melanogaster
KRLDIQEALK

SEQ ID NO: 20135 - protein, 10 aa, Drosophila melanogaster
KRLDIQEALK

SEQ ID NO: 20136 - protein, 10 aa, Drosophila melanogaster
KRLDIQEALK

SEQ ID NO: 20137 - protein, 15 aa, Drosophila melanogaster
IHETVDTINQMKTNR

SEQ ID NO: 20138 - protein, 9 aa, Drosophila melanogaster
YFFTKVNQK

SEQ ID NO: 20139 - protein, 8 aa, Drosophila melanogaster
KLDATIMR

SEQ ID NO: 20140 - protein, 18 aa, Drosophila melanogaster
THTTQETDGFQVKRPGDR

SEQ ID NO: 20141 - protein, 16 aa, Drosophila melanogaster
EFFLSFAKDPQMFIHR

SEQ ID NO: 20142 - protein, 16 aa, Drosophila melanogaster
EFFLSFAKDPQMFIHR

SEQ ID NO: 20143 - protein, 16 aa, Drosophila melanogaster
EFFLSFAKDPQMFIHR

SEQ ID NO: 20144 - protein, 16 aa, Drosophila melanogaster
EFFLSFAKDPQMFIHR

SEQ ID NO: 20145 - protein, 16 aa, Drosophila melanogaster
EFFLSFAKDPQMFIHR

SEQ ID NO: 20146 - protein, 16 aa, Drosophila melanogaster
EFFLSFAKDPQMFIHR

SEQ ID NO: 20147 - protein, 16 aa, Drosophila melanogaster
EFFLSFAKDPQMFIHR

SEQ ID NO: 20148 - protein, 16 aa, Drosophila melanogaster
EFFLSFAKDPQMFIHR

SEQ ID NO: 20149 - protein, 16 aa, Drosophila melanogaster
EFFLSFAKDPQMFIHR

SEQ ID NO: 20150 - protein, 16 aa, Drosophila melanogaster
EFFLSFAKDPQMFIHR

SEQ ID NO: 20151 - protein, 16 aa, Drosophila melanogaster
EFFLSFAKDPQMFIHR

SEQ ID NO: 20152 - protein, 16 aa, Drosophila melanogaster
EFFLSFAKDPQMFIHR

SEQ ID NO: 20153 - protein, 16 aa, Drosophila melanogaster
EFFLSFAKDPQMFIHR

SEQ ID NO: 20154 - protein, 16 aa, Drosophila melanogaster
EFFLSFAKDPQMFIHR

SEQ ID NO: 20155 - protein, 16 aa, Drosophila melanogaster
EFFLSFAKDPQMFIHR

SEQ ID NO: 20156 - protein, 16 aa, Drosophila melanogaster
EFFLSFAKDPQMFIHR

SEQ ID NO: 20157 - protein, 16 aa, Drosophila melanogaster
EFFLSFAKDPQMFIHR

SEQ ID NO: 20158 - protein, 16 aa, Drosophila melanogaster
EFFLSFAKDPQMFIHR

SEQ ID NO: 20159 - protein, 16 aa, Drosophila melanogaster
EFFLSFAKDPQMFIHR

SEQ ID NO: 20160 - protein, 16 aa, Drosophila melanogaster
EFFLSFAKDPQMFIHR

SEQ ID NO: 20161 - protein, 16 aa, Drosophila melanogaster
EFFLSFAKDPQMFIHR

SEQ ID NO: 20162 - protein, 16 aa, Drosophila melanogaster
EFFLSFAKDPQMFIHR

SEQ ID NO: 20163 - protein, 16 aa, Drosophila melanogaster
EFFLSFAKDPQMFIHR

SEQ ID NO: 20164 - protein, 16 aa, Drosophila melanogaster
EFFLSFAKDPQMFIHR

SEQ ID NO: 20165 - protein, 16 aa, Drosophila melanogaster
EFFLSFAKDPQMFIHR

SEQ ID NO: 20166 - protein, 16 aa, Drosophila melanogaster
EFFLSFAKDPQMFIHR

SEQ ID NO: 20167 - protein, 16 aa, Drosophila melanogaster
EFFLSFAKDPQMFIHR

SEQ ID NO: 20168 - protein, 16 aa, Drosophila melanogaster
EFFLSFAKDPQMFIHR

SEQ ID NO: 20169 - protein, 16 aa, Drosophila melanogaster
EFFLSFAKDPQMFIHR

SEQ ID NO: 20170 - protein, 16 aa, Drosophila melanogaster
EFFLSFAKDPQMFIHR

SEQ ID NO: 20171 - protein, 16 aa, Drosophila melanogaster
EFFLSFAKDPQMFIHR

SEQ ID NO: 20172 - protein, 16 aa, Drosophila melanogaster
EFFLSFAKDPQMFIHR

SEQ ID NO: 20173 - protein, 16 aa, Drosophila melanogaster
EFFLSFAKDPQMFIHR

SEQ ID NO: 20174 - protein, 16 aa, Drosophila melanogaster
EFFLSFAKDPQMFIHR

SEQ ID NO: 20175 - protein, 16 aa, Drosophila melanogaster
EFFLSFAKDPQMFIHR

SEQ ID NO: 20176 - protein, 16 aa, Drosophila melanogaster
EFFLSFAKDPQMFIHR

SEQ ID NO: 20177 - protein, 16 aa, Drosophila melanogaster
EFFLSFAKDPQMFIHR

SEQ ID NO: 20178 - protein, 16 aa, Drosophila melanogaster
EFFLSFAKDPQMFIHR

SEQ ID NO: 20179 - protein, 16 aa, Drosophila melanogaster
EFFLSFAKDPQMFIHR

SEQ ID NO: 20180 - protein, 16 aa, Drosophila melanogaster
EFFLSFAKDPQMFIHR

SEQ ID NO: 20181 - protein, 16 aa, Drosophila melanogaster
EFFLSFAKDPQMFIHR

SEQ ID NO: 20182 - protein, 16 aa, Drosophila melanogaster
EFFLSFAKDPQMFIHR

SEQ ID NO: 20183 - protein, 16 aa, Drosophila melanogaster
EFFLSFAKDPQMFIHR

SEQ ID NO: 20184 - protein, 16 aa, Drosophila melanogaster
EFFLSFAKDPQMFIHR

SEQ ID NO: 20185 - protein, 16 aa, Drosophila melanogaster
EFFLSFAKDPQMFIHR

SEQ ID NO: 20186 - protein, 16 aa, Drosophila melanogaster
EFFLSFAKDPQMFIHR

SEQ ID NO: 20187 - protein, 16 aa, Drosophila melanogaster
EFFLSFAKDPQMFIHR

SEQ ID NO: 20188 - protein, 16 aa, Drosophila melanogaster
EFFLSFAKDPQMFIHR

SEQ ID NO: 20189 - protein, 16 aa, Drosophila melanogaster
EFFLSFAKDPQMFIHR

SEQ ID NO: 20190 - protein, 16 aa, Drosophila melanogaster
EFFLSFAKDPQMFIHR

SEQ ID NO: 20191 - protein, 16 aa, Drosophila melanogaster
EFFLSFAKDPQMFIHR

SEQ ID NO: 20192 - protein, 16 aa, Drosophila melanogaster
EFFLSFAKDPQMFIHR

SEQ ID NO: 20193 - protein, 16 aa, Drosophila melanogaster
EFFLSFAKDPQMFIHR

SEQ ID NO: 20194 - protein, 16 aa, Drosophila melanogaster
EFFLSFAKDPQMFIHR

SEQ ID NO: 20195 - protein, 16 aa, Drosophila melanogaster
EFFLSFAKDPQMFIHR

SEQ ID NO: 20196 - protein, 16 aa, Drosophila melanogaster
EFFLSFAKDPQMFIHR

SEQ ID NO: 20197 - protein, 16 aa, Drosophila melanogaster
EFFLSFAKDPQMFIHR

SEQ ID NO: 20198 - protein, 16 aa, Drosophila melanogaster
EFFLSFAKDPQMFIHR

SEQ ID NO: 20199 - protein, 16 aa, Drosophila melanogaster
EFFLSFAKDPQMFIHR

SEQ ID NO: 20200 - protein, 16 aa, Drosophila melanogaster
EFFLSFAKDPQMFIHR

SEQ ID NO: 20201 - protein, 16 aa, Drosophila melanogaster
EFFLSFAKDPQMFIHR

SEQ ID NO: 20202 - protein, 16 aa, Drosophila melanogaster
EFFLSFAKDPQMFIHR

SEQ ID NO: 20203 - protein, 16 aa, Drosophila melanogaster
EFFLSFAKDPQMFIHR

SEQ ID NO: 20204 - protein, 16 aa, Drosophila melanogaster
EFFLSFAKDPQMFIHR

SEQ ID NO: 20205 - protein, 16 aa, Drosophila melanogaster
EFFLSFAKDPQMFIHR

SEQ ID NO: 20206 - protein, 16 aa, Drosophila melanogaster
EFFLSFAKDPQMFIHR

SEQ ID NO: 20207 - protein, 16 aa, Drosophila melanogaster
EFFLSFAKDPQMFIHR

SEQ ID NO: 20208 - protein, 16 aa, Drosophila melanogaster
EFFLSFAKDPQMFIHR

SEQ ID NO: 20209 - protein, 16 aa, Drosophila melanogaster
EFFLSFAKDPQMFIHR

SEQ ID NO: 20210 - protein, 16 aa, Drosophila melanogaster
EFFLSFAKDPQMFIHR

SEQ ID NO: 20211 - protein, 16 aa, Drosophila melanogaster
EFFLSFAKDPQMFIHR

SEQ ID NO: 20212 - protein, 16 aa, Drosophila melanogaster
EFFLSFAKDPQMFIHR

SEQ ID NO: 20213 - protein, 16 aa, Drosophila melanogaster
EFFLSFAKDPQMFIHR

SEQ ID NO: 20214 - protein, 16 aa, Drosophila melanogaster
EFFLSFAKDPQMFIHR

SEQ ID NO: 20215 - protein, 15 aa, Drosophila melanogaster
IHETVDTINQMKTNR

SEQ ID NO: 20216 - protein, 15 aa, Drosophila melanogaster
IHETVDTINQMKTNR

SEQ ID NO: 20217 - protein, 15 aa, Drosophila melanogaster
IHETVDTINQMKTNR

SEQ ID NO: 20218 - protein, 15 aa, Drosophila melanogaster
IHETVDTINQMKTNR

SEQ ID NO: 20219 - protein, 17 aa, Drosophila melanogaster
DLKLMTDVAGNPEEERR

SEQ ID NO: 20220 - protein, 7 aa, Drosophila melanogaster
KFSSFFK

SEQ ID NO: 20221 - protein, 7 aa, Drosophila melanogaster
KFSSFFK

SEQ ID NO: 20222 - protein, 14 aa, Drosophila melanogaster
LLEDGKGDPNTKIK

SEQ ID NO: 20223 - protein, 8 aa, Drosophila melanogaster
RKFSSFFK

SEQ ID NO: 20224 - protein, 8 aa, Drosophila melanogaster
RKFSSFFK

SEQ ID NO: 20225 - protein, 7 aa, Drosophila melanogaster
KFSSFFK

SEQ ID NO: 20226 - protein, 14 aa, Drosophila melanogaster
LLEDGKGDPNTKIK

SEQ ID NO: 20227 - protein, 8 aa, Drosophila melanogaster
RKFSSFFK

SEQ ID NO: 20228 - protein, 7 aa, Drosophila melanogaster
KFSSFFK

SEQ ID NO: 20229 - protein, 7 aa, Drosophila melanogaster
KFSSFFK

SEQ ID NO: 20230 - protein, 7 aa, Drosophila melanogaster
KFSSFFK

SEQ ID NO: 20231 - protein, 17 aa, Drosophila melanogaster
EYINCDKYLEQIFSCQR

SEQ ID NO: 20232 - protein, 17 aa, Drosophila melanogaster
EYINCDKYLEQIFSCQR

SEQ ID NO: 20233 - protein, 17 aa, Drosophila melanogaster
EYINCDKYLEQIFSCQR

SEQ ID NO: 20234 - protein, 17 aa, Drosophila melanogaster
EYINCDKYLEQIFSCQR

SEQ ID NO: 20235 - protein, 17 aa, Drosophila melanogaster
EYINCDKYLEQIFSCQR

SEQ ID NO: 20236 - protein, 17 aa, Drosophila melanogaster
EYINCDKYLEQIFSCQR

SEQ ID NO: 20237 - protein, 17 aa, Drosophila melanogaster
EYINCDKYLEQIFSCQR

SEQ ID NO: 20238 - protein, 17 aa, Drosophila melanogaster
EYINCDKYLEQIFSCQR

SEQ ID NO: 20239 - protein, 17 aa, Drosophila melanogaster
EYINCDKYLEQIFSCQR

SEQ ID NO: 20240 - protein, 17 aa, Drosophila melanogaster
EYINCDKYLEQIFSCQR

SEQ ID NO: 20241 - protein, 17 aa, Drosophila melanogaster
DLKLMTDVAGNPEEERR

SEQ ID NO: 20242 - protein, 17 aa, Drosophila melanogaster
DLKLMTDVAGNPEEERR

SEQ ID NO: 20243 - protein, 16 aa, Drosophila melanogaster
DLKLMTDVAGNPEEER

SEQ ID NO: 20244 - protein, 17 aa, Drosophila melanogaster
DLKLMTDVAGNPEEERR

SEQ ID NO: 20245 - protein, 9 aa, Drosophila melanogaster
YFFTKVNQK

SEQ ID NO: 20246 - protein, 17 aa, Drosophila melanogaster
DLKLMTDVAGNPEEERR

SEQ ID NO: 20247 - protein, 7 aa, Drosophila melanogaster
KFSSFFK

SEQ ID NO: 20248 - protein, 17 aa, Drosophila melanogaster
GTGAGGGGVGSGGGSKR

SEQ ID NO: 20249 - protein, 17 aa, Drosophila melanogaster
GTGAGGGGVGSGGGSKR

SEQ ID NO: 20250 - protein, 17 aa, Drosophila melanogaster
GTGAGGGGVGSGGGSKR

SEQ ID NO: 20251 - protein, 12 aa, Drosophila melanogaster
LLEDGKGDPNTK

SEQ ID NO: 20252 - protein, 17 aa, Drosophila melanogaster
GTGAGGGGVGSGGGSKR

SEQ ID NO: 20253 - protein, 17 aa, Drosophila melanogaster
GTGAGGGGVGSGGGSKR

SEQ ID NO: 20254 - protein, 8 aa, Drosophila melanogaster
KLDATIMR

SEQ ID NO: 20255 - protein, 16 aa, Drosophila melanogaster
EFFLSFAKDPQMFIHR

SEQ ID NO: 20256 - protein, 15 aa, Drosophila melanogaster
IHETVDTINQMKTNR

SEQ ID NO: 20257 - protein, 17 aa, Drosophila melanogaster
GTGAGGGGVGSGGGSKR

SEQ ID NO: 20258 - protein, 15 aa, Drosophila melanogaster
IHETVDTINQMKTNR

SEQ ID NO: 20259 - protein, 15 aa, Drosophila melanogaster
IHETVDTINQMKTNR

SEQ ID NO: 20260 - protein, 15 aa, Drosophila melanogaster
IHETVDTINQMKTNR

SEQ ID NO: 20261 - protein, 17 aa, Drosophila melanogaster
GTGAGGGGVGSGGGSKR

SEQ ID NO: 20262 - protein, 9 aa, Drosophila melanogaster
YFFTKVNQK

SEQ ID NO: 20263 - protein, 16 aa, Drosophila melanogaster
DLKLMTDVAGNPEEER

SEQ ID NO: 20264 - protein, 17 aa, Drosophila melanogaster
GTGAGGGGVGSGGGSKR

SEQ ID NO: 20265 - protein, 9 aa, Drosophila melanogaster
MKFAEIPQR

SEQ ID NO: 20266 - protein, 9 aa, Drosophila melanogaster
MKFAEIPQR

SEQ ID NO: 20267 - protein, 9 aa, Drosophila melanogaster
MKFAEIPQR

SEQ ID NO: 20268 - protein, 17 aa, Drosophila melanogaster
GTGAGGGGVGSGGGSKR

SEQ ID NO: 20269 - protein, 17 aa, Drosophila melanogaster
GTGAGGGGVGSGGGSKR

SEQ ID NO: 20270 - protein, 17 aa, Drosophila melanogaster
GTGAGGGGVGSGGGSKR

SEQ ID NO: 20271 - protein, 17 aa, Drosophila melanogaster
GTGAGGGGVGSGGGSKR

SEQ ID NO: 20272 - protein, 17 aa, Drosophila melanogaster
GTGAGGGGVGSGGGSKR

SEQ ID NO: 20273 - protein, 17 aa, Drosophila melanogaster
GTGAGGGGVGSGGGSKR

SEQ ID NO: 20274 - protein, 17 aa, Drosophila melanogaster
GTGAGGGGVGSGGGSKR

SEQ ID NO: 20275 - protein, 8 aa, Drosophila melanogaster
SDFATAKK

SEQ ID NO: 20276 - protein, 10 aa, Drosophila melanogaster
THKLQDAHER

SEQ ID NO: 20277 - protein, 10 aa, Drosophila melanogaster
THKLQDAHER

SEQ ID NO: 20278 - protein, 10 aa, Drosophila melanogaster
THKLQDAHER

SEQ ID NO: 20279 - protein, 12 aa, Drosophila melanogaster
LDIQEALKRPMK

SEQ ID NO: 20280 - protein, 12 aa, Drosophila melanogaster
LDIQEALKRPMK

SEQ ID NO: 20281 - protein, 15 aa, Drosophila melanogaster
IHETVDTINQMKTNR

SEQ ID NO: 20282 - protein, 12 aa, Drosophila melanogaster
LDIQEALKRPMK

SEQ ID NO: 20283 - protein, 12 aa, Drosophila melanogaster
LDIQEALKRPMK

SEQ ID NO: 20284 - protein, 7 aa, Drosophila melanogaster
KFSSFFK

SEQ ID NO: 20285 - protein, 7 aa, Drosophila melanogaster
KFSSFFK

SEQ ID NO: 20286 - protein, 12 aa, Drosophila melanogaster
LLEDGKGDPNTK

SEQ ID NO: 20287 - protein, 4 aa, Drosophila melanogaster
RKLR

SEQ ID NO: 20288 - protein, 4 aa, Drosophila melanogaster
RKLR

SEQ ID NO: 20289 - protein, 16 aa, Drosophila melanogaster
EFFLSFAKDPQMFIHR

SEQ ID NO: 20290 - protein, 16 aa, Drosophila melanogaster
EFFLSFAKDPQMFIHR

SEQ ID NO: 20291 - protein, 16 aa, Drosophila melanogaster
EFFLSFAKDPQMFIHR

SEQ ID NO: 20292 - protein, 16 aa, Drosophila melanogaster
EFFLSFAKDPQMFIHR

SEQ ID NO: 20293 - protein, 28 aa, Drosophila melanogaster
IFISNTFYPSKEPTNDGEEGAVASWELR

SEQ ID NO: 20294 - protein, 18 aa, Drosophila melanogaster
THTTQETDGFQVKRPGDR

SEQ ID NO: 20295 - protein, 18 aa, Drosophila melanogaster
THTTQETDGFQVKRPGDR

SEQ ID NO: 20296 - protein, 18 aa, Drosophila melanogaster
THTTQETDGFQVKRPGDR

SEQ ID NO: 20297 - protein, 18 aa, Drosophila melanogaster
THTTQETDGFQVKRPGDR

SEQ ID NO: 20298 - protein, 18 aa, Drosophila melanogaster
THTTQETDGFQVKRPGDR

SEQ ID NO: 20299 - protein, 18 aa, Drosophila melanogaster
THTTQETDGFQVKRPGDR

SEQ ID NO: 20300 - protein, 18 aa, Drosophila melanogaster
THTTQETDGFQVKRPGDR

SEQ ID NO: 20301 - protein, 18 aa, Drosophila melanogaster
THTTQETDGFQVKRPGDR

SEQ ID NO: 20302 - protein, 18 aa, Drosophila melanogaster
THTTQETDGFQVKRPGDR

SEQ ID NO: 20303 - protein, 14 aa, Drosophila melanogaster
THTTQETDGFQVKR

SEQ ID NO: 20304 - protein, 18 aa, Drosophila melanogaster
THTTQETDGFQVKRPGDR

SEQ ID NO: 20305 - protein, 18 aa, Drosophila melanogaster
THTTQETDGFQVKRPGDR

SEQ ID NO: 20306 - protein, 18 aa, Drosophila melanogaster
THTTQETDGFQVKRPGDR

SEQ ID NO: 20307 - protein, 18 aa, Drosophila melanogaster
THTTQETDGFQVKRPGDR

SEQ ID NO: 20308 - protein, 18 aa, Drosophila melanogaster
THTTQETDGFQVKRPGDR

SEQ ID NO: 20309 - protein, 18 aa, Drosophila melanogaster
THTTQETDGFQVKRPGDR

SEQ ID NO: 20310 - protein, 9 aa, Drosophila melanogaster
MKFAEIPQR

SEQ ID NO: 20311 - protein, 15 aa, Drosophila melanogaster
IHETVDTINQMKTNR

SEQ ID NO: 20312 - protein, 15 aa, Drosophila melanogaster
IHETVDTINQMKTNR

SEQ ID NO: 20313 - protein, 16 aa, Drosophila melanogaster
EFFLSFAKDPQMFIHR

SEQ ID NO: 20314 - protein, 16 aa, Drosophila melanogaster
EFFLSFAKDPQMFIHR

SEQ ID NO: 20315 - protein, 16 aa, Drosophila melanogaster
EFFLSFAKDPQMFIHR

SEQ ID NO: 20316 - protein, 16 aa, Drosophila melanogaster
EFFLSFAKDPQMFIHR

SEQ ID NO: 20317 - protein, 16 aa, Drosophila melanogaster
EFFLSFAKDPQMFIHR

SEQ ID NO: 20318 - protein, 15 aa, Drosophila melanogaster
IHETVDTINQMKTNR

SEQ ID NO: 20319 - protein, 15 aa, Drosophila melanogaster
IHETVDTINQMKTNR

SEQ ID NO: 20320 - protein, 15 aa, Drosophila melanogaster
IHETVDTINQMKTNR

SEQ ID NO: 20321 - protein, 10 aa, Drosophila melanogaster
THKLQDAHER

SEQ ID NO: 20322 - protein, 10 aa, Drosophila melanogaster
THKLQDAHER

SEQ ID NO: 20323 - protein, 10 aa, Drosophila melanogaster
THKLQDAHER

SEQ ID NO: 20324 - protein, 10 aa, Drosophila melanogaster
THKLQDAHER

SEQ ID NO: 20325 - protein, 10 aa, Drosophila melanogaster
THKLQDAHER

SEQ ID NO: 20326 - protein, 10 aa, Drosophila melanogaster
THKLQDAHER

SEQ ID NO: 20327 - protein, 10 aa, Drosophila melanogaster
THKLQDAHER

SEQ ID NO: 20328 - protein, 10 aa, Drosophila melanogaster
THKLQDAHER

SEQ ID NO: 20329 - protein, 15 aa, Drosophila melanogaster
IHETVDTINQMKTNR

SEQ ID NO: 20330 - protein, 13 aa, Drosophila melanogaster
KFYVDTNYVTVPR

SEQ ID NO: 20331 - protein, 13 aa, Drosophila melanogaster
KFYVDTNYVTVPR

SEQ ID NO: 20332 - protein, 6 aa, Drosophila melanogaster
KGGGNR

SEQ ID NO: 20333 - protein, 6 aa, Drosophila melanogaster
KGGGNR

SEQ ID NO: 20334 - protein, 6 aa, Drosophila melanogaster
KGGGNR

SEQ ID NO: 20335 - protein, 10 aa, Drosophila melanogaster
KNAVEGESDR

SEQ ID NO: 20336 - protein, 11 aa, Drosophila melanogaster
LDMELEGQKLR

SEQ ID NO: 20337 - protein, 11 aa, Drosophila melanogaster
LDMELEGQKLR

SEQ ID NO: 20338 - protein, 7 aa, Drosophila melanogaster
KIRDQDR

SEQ ID NO: 20339 - protein, 7 aa, Drosophila melanogaster
KIRDQDR

SEQ ID NO: 20340 - protein, 7 aa, Drosophila melanogaster
KIRDQDR

SEQ ID NO: 20341 - protein, 5 aa, Drosophila melanogaster
KPEIK

SEQ ID NO: 20342 - protein, 14 aa, Drosophila melanogaster
QQFHLEQLKAAEFR

SEQ ID NO: 20343 - protein, 14 aa, Drosophila melanogaster
QQFHLEQLKAAEFR

SEQ ID NO: 20344 - protein, 6 aa, Drosophila melanogaster
SDKSNK

SEQ ID NO: 20345 - protein, 6 aa, Drosophila melanogaster
SDKSNK

SEQ ID NO: 20346 - protein, 6 aa, Drosophila melanogaster
SDKSNK

SEQ ID NO: 20347 - protein, 14 aa, Drosophila melanogaster
MSIDDIMSFGDEKK

SEQ ID NO: 20348 - protein, 14 aa, Drosophila melanogaster
MSIDDIMSFGDEKK

SEQ ID NO: 20349 - protein, 14 aa, Drosophila melanogaster
MSIDDIMSFGDEKK

SEQ ID NO: 20350 - protein, 14 aa, Drosophila melanogaster
MSIDDIMSFGDEKK

SEQ ID NO: 20351 - protein, 14 aa, Drosophila melanogaster
MSIDDIMSFGDEKK

SEQ ID NO: 20352 - protein, 14 aa, Drosophila melanogaster
MSIDDIMSFGDEKK

SEQ ID NO: 20353 - protein, 12 aa, Drosophila melanogaster
LGKNSADPPATR

SEQ ID NO: 20354 - protein, 12 aa, Drosophila melanogaster
LGKNSADPPATR

SEQ ID NO: 20355 - protein, 12 aa, Drosophila melanogaster
LGKNSADPPATR

SEQ ID NO: 20356 - protein, 12 aa, Drosophila melanogaster
LGKNSADPPATR

SEQ ID NO: 20357 - protein, 12 aa, Drosophila melanogaster
LGKNSADPPATR

SEQ ID NO: 20358 - protein, 12 aa, Drosophila melanogaster
LGKNSADPPATR

SEQ ID NO: 20359 - protein, 11 aa, Drosophila melanogaster
SKTPEIYMAYR

SEQ ID NO: 20360 - protein, 11 aa, Drosophila melanogaster
SKTPEIYMAYR

SEQ ID NO: 20361 - protein, 11 aa, Drosophila melanogaster
SKTPEIYMAYR

SEQ ID NO: 20362 - protein, 11 aa, Drosophila melanogaster
SKTPEIYMAYR

SEQ ID NO: 20363 - protein, 12 aa, Drosophila melanogaster
TLLDLDKKPLGK

SEQ ID NO: 20364 - protein, 12 aa, Drosophila melanogaster
TLLDLDKKPLGK

SEQ ID NO: 20365 - protein, 12 aa, Drosophila melanogaster
TLLDLDKKPLGK

SEQ ID NO: 20366 - protein, 12 aa, Drosophila melanogaster
TLLDLDKKPLGK

SEQ ID NO: 20367 - protein, 12 aa, Drosophila melanogaster
TLLDLDKKPLGK

SEQ ID NO: 20368 - protein, 7 aa, Drosophila melanogaster
GFEGKLR

SEQ ID NO: 20369 - protein, 7 aa, Drosophila melanogaster
GFEGKLR

SEQ ID NO: 20370 - protein, 6 aa, Drosophila melanogaster
KTHKQR

SEQ ID NO: 20371 - protein, 7 aa, Drosophila melanogaster
GFEGKLR

SEQ ID NO: 20372 - protein, 7 aa, Drosophila melanogaster
DNTKSDK

SEQ ID NO: 20373 - protein, 7 aa, Drosophila melanogaster
DNTKSDK

SEQ ID NO: 20374 - protein, 30 aa, Drosophila melanogaster
VAAAAAKAAMEEFAAIKDEVPATIMDNHLK

SEQ ID NO: 20375 - protein, 30 aa, Drosophila melanogaster; identical to SEQ ID NO: 20374

SEQ ID NO: 20376 - protein, 6 aa, Drosophila melanogaster
KPAAMR

SEQ ID NO: 20377 - protein, 6 aa, Drosophila melanogaster
KPAAMR

SEQ ID NO: 20378 - protein, 6 aa, Drosophila melanogaster
KPAAMR

SEQ ID NO: 20379 - protein, 6 aa, Drosophila melanogaster
KPAAMR

SEQ ID NO: 20380 - protein, 5 aa, Drosophila melanogaster
THKQR

SEQ ID NO: 20381 - protein, 5 aa, Drosophila melanogaster
THKQR

SEQ ID NO: 20382 - protein, 5 aa, Drosophila melanogaster
THKQR

SEQ ID NO: 20383 - protein, 10 aa, Drosophila melanogaster
KPAASSGGGK

SEQ ID NO: 20384 - protein, 10 aa, Drosophila melanogaster
KPAASSGGGK

SEQ ID NO: 20385 - protein, 5 aa, Drosophila melanogaster
THKQR

SEQ ID NO: 20386 - protein, 5 aa, Drosophila melanogaster
THKQR

SEQ ID NO: 20387 - protein, 5 aa, Drosophila melanogaster
THKQR

SEQ ID NO: 20388 - protein, 5 aa, Drosophila melanogaster
THKQR

SEQ ID NO: 20389 - protein, 5 aa, Drosophila melanogaster
THKQR

SEQ ID NO: 20390 - protein, 5 aa, Drosophila melanogaster
THKQR

SEQ ID NO: 20391 - protein, 5 aa, Drosophila melanogaster
THKQR

SEQ ID NO: 20392 - protein, 12 aa, Drosophila melanogaster
LDQYAKKPAAMR

SEQ ID NO: 20393 - protein, 18 aa, Drosophila melanogaster
ANAALQSTASPAPGGKSR

SEQ ID NO: 20394 - protein, 18 aa, Drosophila melanogaster
ANAALQSTASPAPGGKSR

SEQ ID NO: 20395 - protein, 18 aa, Drosophila melanogaster
ANAALQSTASPAPGGKSR

SEQ ID NO: 20396 - protein, 5 aa, Drosophila melanogaster
THKQR

SEQ ID NO: 20397 - protein, 5 aa, Drosophila melanogaster
THKQR

SEQ ID NO: 20398 - protein, 4 aa, Drosophila melanogaster
KTHK

SEQ ID NO: 20399 - protein, 12 aa, Drosophila melanogaster
TLLDLDKKPLGK

SEQ ID NO: 20400 - protein, 12 aa, Drosophila melanogaster
TLLDLDKKPLGK

SEQ ID NO: 20401 - protein, 8 aa, Drosophila melanogaster
TLLDLDKK

SEQ ID NO: 20402 - protein, 8 aa, Drosophila melanogaster
TLLDLDKK

SEQ ID NO: 20403 - protein, 8 aa, Drosophila melanogaster
TLLDLDKK

SEQ ID NO: 20404 - protein, 8 aa, Drosophila melanogaster
TLLDLDKK

SEQ ID NO: 20405 - protein, 8 aa, Drosophila melanogaster
TLLDLDKK

SEQ ID NO: 20406 - protein, 12 aa, Drosophila melanogaster
TLLDLDKKPLGK

SEQ ID NO: 20407 - protein, 12 aa, Drosophila melanogaster
TLLDLDKKPLGK

SEQ ID NO: 20408 - protein, 12 aa, Drosophila melanogaster
TLLDLDKKPLGK

SEQ ID NO: 20409 - protein, 14 aa, Drosophila melanogaster
KPLGKDGGLELGDK

SEQ ID NO: 20410 - protein, 6 aa, Drosophila melanogaster
KDDDAK

SEQ ID NO: 20411 - protein, 4 aa, Drosophila melanogaster
KTHK

SEQ ID NO: 20412 - protein, 4 aa, Drosophila melanogaster
KTHK

SEQ ID NO: 20413 - protein, 15 aa, Drosophila melanogaster
KIKSLVALLVETQMK

SEQ ID NO: 20414 - protein, 10 aa, Drosophila melanogaster
AKHLAALEER

SEQ ID NO: 20415 - protein, 10 aa, Drosophila melanogaster
AKHLAALEER

SEQ ID NO: 20416 - protein, 10 aa, Drosophila melanogaster
AKHLAALEER

SEQ ID NO: 20417 - protein, 5 aa, Drosophila melanogaster
KLEIK

SEQ ID NO: 20418 - protein, 7 aa, Drosophila melanogaster
GFEGKLR

SEQ ID NO: 20419 - protein, 7 aa, Drosophila melanogaster
GFEGKLR

SEQ ID NO: 20420 - protein, 7 aa, Drosophila melanogaster
GFEGKLR

SEQ ID NO: 20421 - protein, 7 aa, Drosophila melanogaster
SAIKSDK

SEQ ID NO: 20422 - protein, 7 aa, Drosophila melanogaster
SAIKSDK

SEQ ID NO: 20423 - protein, 7 aa, Drosophila melanogaster
SAIKSDK

SEQ ID NO: 20424 - protein, 7 aa, Drosophila melanogaster
SAIKSDK

SEQ ID NO: 20425 - protein, 23 aa, Drosophila melanogaster
AAMEEFAAIKDEVPATIMDNHLK

SEQ ID NO: 20426 - protein, 23 aa, Drosophila melanogaster
AAMEEFAAIKDEVPATIMDNHLK

SEQ ID NO: 20427 - protein, 23 aa, Drosophila melanogaster
AAMEEFAAIKDEVPATIMDNHLK

SEQ ID NO: 20428 - protein, 23 aa, Drosophila melanogaster
AAMEEFAAIKDEVPATIMDNHLK

SEQ ID NO: 20429 - protein, 23 aa, Drosophila melanogaster
AAMEEFAAIKDEVPATIMDNHLK

SEQ ID NO: 20430 - protein, 23 aa, Drosophila melanogaster
AAMEEFAAIKDEVPATIMDNHLK

SEQ ID NO: 20431 - protein, 23 aa, Drosophila melanogaster
AAMEEFAAIKDEVPATIMDNHLK

SEQ ID NO: 20432 - protein, 23 aa, Drosophila melanogaster
AAMEEFAAIKDEVPATIMDNHLK

SEQ ID NO: 20433 - protein, 23 aa, Drosophila melanogaster
AAMEEFAAIKDEVPATIMDNHLK

SEQ ID NO: 20434 - protein, 23 aa, Drosophila melanogaster
AAMEEFAAIKDEVPATIMDNHLK

SEQ ID NO: 20435 - protein, 23 aa, Drosophila melanogaster
AAMEEFAAIKDEVPATIMDNHLK

SEQ ID NO: 20436 - protein, 23 aa, Drosophila melanogaster
AAMEEFAAIKDEVPATIMDNHLK

SEQ ID NO: 20437 - protein, 23 aa, Drosophila melanogaster
AAMEEFAAIKDEVPATIMDNHLK

SEQ ID NO: 20438 - protein, 23 aa, Drosophila melanogaster
AAMEEFAAIKDEVPATIMDNHLK

SEQ ID NO: 20439 - protein, 23 aa, Drosophila melanogaster
AAMEEFAAIKDEVPATIMDNHLK

SEQ ID NO: 20440 - protein, 23 aa, Drosophila melanogaster
AAMEEFAAIKDEVPATIMDNHLK

SEQ ID NO: 20441 - protein, 23 aa, Drosophila melanogaster
AAMEEFAAIKDEVPATIMDNHLK

SEQ ID NO: 20442 - protein, 23 aa, Drosophila melanogaster
AAMEEFAAIKDEVPATIMDNHLK

SEQ ID NO: 20443 - protein, 23 aa, Drosophila melanogaster
AAMEEFAAIKDEVPATIMDNHLK

SEQ ID NO: 20444 - protein, 6 aa, Drosophila melanogaster
SKDNTK

SEQ ID NO: 20445 - protein, 10 aa, Drosophila melanogaster
DLSKKDDDAK

SEQ ID NO: 20446 - protein, 10 aa, Drosophila melanogaster
AKHLAALEER

SEQ ID NO: 20447 - protein, 9 aa, Drosophila melanogaster
VMQAVDKVR

SEQ ID NO: 20448 - protein, 9 aa, Drosophila melanogaster
VMQAVDKVR

SEQ ID NO: 20449 - protein, 10 aa, Drosophila melanogaster
SEEEIEIFKR

SEQ ID NO: 20450 - protein, 10 aa, Drosophila melanogaster
SEEEIEIFKR

SEQ ID NO: 20451 - protein, 10 aa, Drosophila melanogaster
SEEEIEIFKR

SEQ ID NO: 20452 - protein, 10 aa, Drosophila melanogaster
SEEEIEIFKR

SEQ ID NO: 20453 - protein, 10 aa, Drosophila melanogaster
SEEEIEIFKR

SEQ ID NO: 20454 - protein, 11 aa, Drosophila melanogaster
KKEDEEIHPGR

SEQ ID NO: 20455 - protein, 10 aa, Drosophila melanogaster
SEEEIEIFKR

SEQ ID NO: 20456 - protein, 10 aa, Drosophila melanogaster
SEEEIEIFKR

SEQ ID NO: 20457 - protein, 10 aa, Drosophila melanogaster
SEEEIEIFKR

SEQ ID NO: 20458 - protein, 10 aa, Drosophila melanogaster
SEEEIEIFKR

SEQ ID NO: 20459 - protein, 10 aa, Drosophila melanogaster
SEEEIEIFKR

SEQ ID NO: 20460 - protein, 10 aa, Drosophila melanogaster
SEEEIEIFKR

SEQ ID NO: 20461 - protein, 10 aa, Drosophila melanogaster
SEEEIEIFKR

SEQ ID NO: 20462 - protein, 10 aa, Drosophila melanogaster
SEEEIEIFKR

SEQ ID NO: 20463 - protein, 10 aa, Drosophila melanogaster
SEEEIEIFKR

SEQ ID NO: 20464 - protein, 10 aa, Drosophila melanogaster
SEEEIEIFKR

SEQ ID NO: 20465 - protein, 5 aa, Drosophila melanogaster
KILQR

SEQ ID NO: 20466 - protein, 14 aa, Drosophila melanogaster
MNKAVMNHHANAER

SEQ ID NO: 20467 - protein, 14 aa, Drosophila melanogaster
MNKAVMNHHANAER

SEQ ID NO: 20468 - protein, 14 aa, Drosophila melanogaster
MNKAVMNHHANAER

SEQ ID NO: 20469 - protein, 14 aa, Drosophila melanogaster
MNKAVMNHHANAER

SEQ ID NO: 20470 - protein, 14 aa, Drosophila melanogaster
MNKAVMNHHANAER

SEQ ID NO: 20471 - protein, 14 aa, Drosophila melanogaster
MNKAVMNHHANAER

SEQ ID NO: 20472 - protein, 14 aa, Drosophila melanogaster
MNKAVMNHHANAER

SEQ ID NO: 20473 - protein, 8 aa, Drosophila melanogaster
EQKKEQER

SEQ ID NO: 20474 - protein, 5 aa, Drosophila melanogaster
IEKER

SEQ ID NO: 20475 - protein, 5 aa, Drosophila melanogaster
IEKER

SEQ ID NO: 20476 - protein, 8 aa, Drosophila melanogaster
EQKKEQER

SEQ ID NO: 20477 - protein, 8 aa, Drosophila melanogaster
EQKKEQER

SEQ ID NO: 20478 - protein, 5 aa, Drosophila melanogaster
IEKER

SEQ ID NO: 20479 - protein, 12 aa, Drosophila melanogaster
QRLPDYYEIIKR

SEQ ID NO: 20480 - protein, 12 aa, Drosophila melanogaster
QRLPDYYEIIKR

SEQ ID NO: 20481 - protein, 5 aa, Drosophila melanogaster
KFNAK

SEQ ID NO: 20482 - protein, 5 aa, Drosophila melanogaster
KFNAK

SEQ ID NO: 20483 - protein, 6 aa, Drosophila melanogaster
YSKVGR

SEQ ID NO: 20484 - protein, 5 aa, Drosophila melanogaster
KFLEK

SEQ ID NO: 20485 - protein, 5 aa, Drosophila melanogaster
KFLEK

SEQ ID NO: 20486 - protein, 13 aa, Drosophila melanogaster
RRKNAVEGESDRK

SEQ ID NO: 20487 - protein, 13 aa, Drosophila melanogaster
RRKNAVEGESDRK

SEQ ID NO: 20488 - protein, 12 aa, Drosophila melanogaster
KAKHLAALEERK

SEQ ID NO: 20489 - protein, 12 aa, Drosophila melanogaster
KAKHLAALEERK

SEQ ID NO: 20490 - protein, 24 aa, Drosophila melanogaster
RQVSSLTMHQTKLEAELQQMEEKF

SEQ ID NO: 20491 - protein, 16 aa, Drosophila melanogaster
RQQFHLEQLKAAEFRA

SEQ ID NO: 20492 - protein, 16 aa, Drosophila melanogaster
RQQFHLEQLKAAEFRA

SEQ ID NO: 20493 - protein, 16 aa, Drosophila melanogaster
RQQFHLEQLKAAEFRA

SEQ ID NO: 20494 - protein, 16 aa, Drosophila melanogaster
RQQFHLEQLKAAEFRA

SEQ ID NO: 20495 - protein, 16 aa, Drosophila melanogaster
RQQFHLEQLKAAEFRA

SEQ ID NO: 20496 - protein, 16 aa, Drosophila melanogaster
RQQFHLEQLKAAEFRA

SEQ ID NO: 20497 - protein, 16 aa, Drosophila melanogaster
RQQFHLEQLKAAEFRA

SEQ ID NO: 20498 - protein, 16 aa, Drosophila melanogaster
RQQFHLEQLKAAEFRA

SEQ ID NO: 20499 - protein, 16 aa, Drosophila melanogaster
RQQFHLEQLKAAEFRA

SEQ ID NO: 20500 - protein, 9 aa, Drosophila melanogaster
KKLEIKLRH

SEQ ID NO: 20501 - protein, 9 aa, Drosophila melanogaster
KKLEIKLRH

SEQ ID NO: 20502 - protein, 14 aa, Drosophila melanogaster
RRTNANVEGTPKRG

SEQ ID NO: 20503 - protein, 14 aa, Drosophila melanogaster
RRTNANVEGTPKRG

SEQ ID NO: 20504 - protein, 16 aa, Drosophila melanogaster
KLKSWPPVREGSSVKF

SEQ ID NO: 20505 - protein, 10 aa, Drosophila melanogaster
RTTAKDEARV

SEQ ID NO: 20506 - protein, 10 aa, Drosophila melanogaster
RRGWLDKLRA

SEQ ID NO: 20507 - protein, 9 aa, Drosophila melanogaster
RKRDELCKD

SEQ ID NO: 20508 - protein, 9 aa, Drosophila melanogaster
RKRDELCKD

SEQ ID NO: 20509 - protein, 16 aa, Drosophila melanogaster
KYKEILENSENFNTRL

SEQ ID NO: 20510 - protein, 12 aa, Drosophila melanogaster
KIQNFLNDKEKY

SEQ ID NO: 20511 - protein, 12 aa, Drosophila melanogaster
KIQNFLNDKEKY

SEQ ID NO: 20512 - protein, 12 aa, Drosophila melanogaster
KIQNFLNDKEKY

SEQ ID NO: 20513 - protein, 22 aa, Drosophila melanogaster
KEITALAPSTMKIKIVAPPERK

SEQ ID NO: 20514 - protein, 26 aa, Drosophila melanogaster
RPRHQGVMVGMGQKDSYVGDEAQSKR

SEQ ID NO: 20515 - protein, 24 aa, Drosophila melanogaster
RKDLYANNVLSGGTTMYPGIADRM

SEQ ID NO: 20516 - protein, 19 aa, Drosophila melanogaster
REYINCDKYLEQIFSCQRM

SEQ ID NO: 20517 - protein, 19 aa, Drosophila melanogaster
REYINCDKYLEQIFSCQRM

SEQ ID NO: 20518 - protein, 19 aa, Drosophila melanogaster
REYINCDKYLEQIFSCQRM

SEQ ID NO: 20519 - protein, 19 aa, Drosophila melanogaster
REYINCDKYLEQIFSCQRM

SEQ ID NO: 20520 - protein, 19 aa, Drosophila melanogaster
REYINCDKYLEQIFSCQRM

SEQ ID NO: 20521 - protein, 19 aa, Drosophila melanogaster
REYINCDKYLEQIFSCQRM

SEQ ID NO: 20522 - protein, 19 aa, Drosophila melanogaster
REYINCDKYLEQIFSCQRM

SEQ ID NO: 20523 - protein, 19 aa, Drosophila melanogaster
REYINCDKYLEQIFSCQRM

SEQ ID NO: 20524 - protein, 19 aa, Drosophila melanogaster
REYINCDKYLEQIFSCQRM

SEQ ID NO: 20525 - protein, 19 aa, Drosophila melanogaster
REYINCDKYLEQIFSCQRM

SEQ ID NO: 20526 - protein, 19 aa, Drosophila melanogaster
REYINCDKYLEQIFSCQRM

SEQ ID NO: 20527 - protein, 20 aa, Drosophila melanogaster
KANAALQSTASPAPGGKSRG

SEQ ID NO: 20528 - protein, 18 aa, Drosophila melanogaster
REFFLSFAKDPQMFIHRW

SEQ ID NO: 20529 - protein, 18 aa, Drosophila melanogaster
REFFLSFAKDPQMFIHRW

SEQ ID NO: 20530 - protein, 18 aa, Drosophila melanogaster
REFFLSFAKDPQMFIHRW

SEQ ID NO: 20531 - protein, 18 aa, Drosophila melanogaster
REFFLSFAKDPQMFIHRW

SEQ ID NO: 20532 - protein, 18 aa, Drosophila melanogaster
REFFLSFAKDPQMFIHRW

SEQ ID NO: 20533 - protein, 12 aa, Drosophila melanogaster
KAKHLAALEERK

SEQ ID NO: 20534 - protein, 12 aa, Drosophila melanogaster
KAKHLAALEERK

SEQ ID NO: 20535 - protein, 16 aa, Drosophila melanogaster
RQQFHLEQLKAAEFRA

SEQ ID NO: 20536 - protein, 16 aa, Drosophila melanogaster
RQQFHLEQLKAAEFRA

SEQ ID NO: 20537 - protein, 16 aa, Drosophila melanogaster
RQQFHLEQLKAAEFRA

SEQ ID NO: 20538 - protein, 16 aa, Drosophila melanogaster
RQQFHLEQLKAAEFRA

SEQ ID NO: 20539 - protein, 16 aa, Drosophila melanogaster
RQQFHLEQLKAAEFRA

SEQ ID NO: 20540 - protein, 16 aa, Drosophila melanogaster
RQQFHLEQLKAAEFRA

SEQ ID NO: 20541 - protein, 16 aa, Drosophila melanogaster
RQQFHLEQLKAAEFRA

SEQ ID NO: 20542 - protein, 16 aa, Drosophila melanogaster
RQQFHLEQLKAAEFRA

SEQ ID NO: 20543 - protein, 16 aa, Drosophila melanogaster
RQQFHLEQLKAAEFRA

SEQ ID NO: 20544 - protein, 16 aa, Drosophila melanogaster
RQQFHLEQLKAAEFRA

SEQ ID NO: 20545 - protein, 16 aa, Drosophila melanogaster
RQQFHLEQLKAAEFRA

SEQ ID NO: 20546 - protein, 16 aa, Drosophila melanogaster
RQQFHLEQLKAAEFRA

SEQ ID NO: 20547 - protein, 16 aa, Drosophila melanogaster
RQQFHLEQLKAAEFRA

SEQ ID NO: 20548 - protein, 16 aa, Drosophila melanogaster
RQQFHLEQLKAAEFRA

SEQ ID NO: 20549 - protein, 16 aa, Drosophila melanogaster
RQQFHLEQLKAAEFRA

SEQ ID NO: 20550 - protein, 12 aa, Drosophila melanogaster
RLEKLCAVLTRH

SEQ ID NO: 20551 - protein, 12 aa, Drosophila melanogaster
RLEKLCAVLTRH

SEQ ID NO: 20552 - protein, 12 aa, Drosophila melanogaster
RLEKLCAVLTRH

SEQ ID NO: 20553 - protein, 12 aa, Drosophila melanogaster
RLEKLCAVLTRH

SEQ ID NO: 20554 - protein, 12 aa, Drosophila melanogaster
RLEKLCAVLTRH

SEQ ID NO: 20555 - protein, 19 aa, Drosophila melanogaster
RGTGAGGGGVGSGGGSKRS

SEQ ID NO: 20556 - protein, 28 aa, Drosophila melanogaster
RRIDIQPAEDEDDQDEGYTTKHLAYARY

SEQ ID NO: 20557 - protein, 28 aa, Drosophila melanogaster
RRIDIQPAEDEDDQDEGYTTKHLAYARY

SEQ ID NO: 20558 - protein, 19 aa, Drosophila melanogaster
RGTGAGGGGVGSGGGSKRS

SEQ ID NO: 20559 - protein, 12 aa, Drosophila melanogaster
RGGGSKSQHERR

SEQ ID NO: 20560 - protein, 18 aa, Drosophila melanogaster
KHLEFLAAVLQHGKDLRE

SEQ ID NO: 20561 - protein, 20 aa, Drosophila melanogaster
RQKHLEFLAAVLQHGKDLRE

SEQ ID NO: 20562 - protein, 18 aa, Drosophila melanogaster
KHLEFLAAVLQHGKDLRE

SEQ ID NO: 20563 - protein, 18 aa, Drosophila melanogaster
KHLEFLAAVLQHGKDLRE

SEQ ID NO: 20564 - protein, 20 aa, Drosophila melanogaster
RQKHLEFLAAVLQHGKDLRE

SEQ ID NO: 20565 - protein, 18 aa, Drosophila melanogaster
KHLEFLAAVLQHGKDLRE

SEQ ID NO: 20566 - protein, 20 aa, Drosophila melanogaster
RQKHLEFLAAVLQHGKDLRE

SEQ ID NO: 20567 - protein, 18 aa, Drosophila melanogaster
KHLEFLAAVLQHGKDLRE

SEQ ID NO: 20568 - protein, 20 aa, Drosophila melanogaster
RQKHLEFLAAVLQHGKDLRE

SEQ ID NO: 20569 - protein, 20 aa, Drosophila melanogaster
RQKHLEFLAAVLQHGKDLRE

SEQ ID NO: 20570 - protein, 18 aa, Drosophila melanogaster
KHLEFLAAVLQHGKDLRE

SEQ ID NO: 20571 - protein, 20 aa, Drosophila melanogaster
RQKHLEFLAAVLQHGKDLRE

SEQ ID NO: 20572 - protein, 18 aa, Drosophila melanogaster
KHLEFLAAVLQHGKDLRE

SEQ ID NO: 20573 - protein, 21 aa, Drosophila melanogaster
KKELIFPHDSVESTTPVLYRR

SEQ ID NO: 20574 - protein, 10 aa, Drosophila melanogaster
KFLEKEVFKS

SEQ ID NO: 20575 - protein, 10 aa, Drosophila melanogaster
KKAFPTSHRT

SEQ ID NO: 20576 - protein, 13 aa, Drosophila melanogaster
RFHPEYFELIKRP

SEQ ID NO: 20577 - protein, 13 aa, Drosophila melanogaster
RTNANVEGTPKRG

SEQ ID NO: 20578 - protein, 14 aa, Drosophila melanogaster
KKPAASSGGGKQKR

SEQ ID NO: 20579 - protein, 25 aa, Drosophila melanogaster
KAAMEEFAAIKDEVPATIMDNHLKN

SEQ ID NO: 20580 - protein, 25 aa, Drosophila melanogaster
KAAMEEFAAIKDEVPATIMDNHLKN

SEQ ID NO: 20581 - protein, 25 aa, Drosophila melanogaster
KAAMEEFAAIKDEVPATIMDNHLKN

SEQ ID NO: 20582 - protein, 11 aa, Drosophila melanogaster
RKNAVEGESDR

SEQ ID NO: 20583 - protein, 11 aa, Drosophila melanogaster
RKNAVEGESDR

SEQ ID NO: 20584 - protein, 10 aa, Drosophila melanogaster
AKHLAALEER

SEQ ID NO: 20585 - protein, 10 aa, Drosophila melanogaster
AKHLAALEER

SEQ ID NO: 20586 - protein, 22 aa, Drosophila melanogaster
QVSSLTMHQTKLEAELQQMEEK

SEQ ID NO: 20587 - protein, 14 aa, Drosophila melanogaster
QQFHLEQLKAAEFR

SEQ ID NO: 20588 - protein, 14 aa, Drosophila melanogaster
QQFHLEQLKAAEFR

SEQ ID NO: 20589 - protein, 14 aa, Drosophila melanogaster
QQFHLEQLKAAEFR

SEQ ID NO: 20590 - protein, 14 aa, Drosophila melanogaster
QQFHLEQLKAAEFR

SEQ ID NO: 20591 - protein, 14 aa, Drosophila melanogaster
QQFHLEQLKAAEFR

SEQ ID NO: 20592 - protein, 14 aa, Drosophila melanogaster
QQFHLEQLKAAEFR

SEQ ID NO: 20593 - protein, 14 aa, Drosophila melanogaster
QQFHLEQLKAAEFR

SEQ ID NO: 20594 - protein, 14 aa, Drosophila melanogaster
QQFHLEQLKAAEFR

SEQ ID NO: 20595 - protein, 14 aa, Drosophila melanogaster
QQFHLEQLKAAEFR

SEQ ID NO: 20596 - protein, 7 aa, Drosophila melanogaster
KLEIKLR

SEQ ID NO: 20597 - protein, 7 aa, Drosophila melanogaster
KLEIKLR

SEQ ID NO: 20598 - protein, 12 aa, Drosophila melanogaster
RTNANVEGTPKR

SEQ ID NO: 20599 - protein, 12 aa, Drosophila melanogaster
RTNANVEGTPKR

SEQ ID NO: 20600 - protein, 14 aa, Drosophila melanogaster
LKSWPPVREGSSVK

SEQ ID NO: 20601 - protein, 8 aa, Drosophila melanogaster
TTAKDEAR

SEQ ID NO: 20602 - protein, 8 aa, Drosophila melanogaster
RGWLDKLR

SEQ ID NO: 20603 - protein, 7 aa, Drosophila melanogaster
KRDELCK

SEQ ID NO: 20604 - protein, 7 aa, Drosophila melanogaster
KRDELCK

SEQ ID NO: 20605 - protein, 14 aa, Drosophila melanogaster
YKEILENSENFNTR

SEQ ID NO: 20606 - protein, 10 aa, Drosophila melanogaster
IQNFLNDKEK

SEQ ID NO: 20607 - protein, 10 aa, Drosophila melanogaster
IQNFLNDKEK

SEQ ID NO: 20608 - protein, 10 aa, Drosophila melanogaster
IQNFLNDKEK

SEQ ID NO: 20609 - protein, 20 aa, Drosophila melanogaster
EITALAPSTMKIKIVAPPER

SEQ ID NO: 20610 - protein, 24 aa, Drosophila melanogaster
PRHQGVMVGMGQKDSYVGDEAQSK

SEQ ID NO: 20611 - protein, 22 aa, Drosophila melanogaster
KDLYANNVLSGGTTMYPGIADR

SEQ ID NO: 20612 - protein, 17 aa, Drosophila melanogaster
EYINCDKYLEQIFSCQR

SEQ ID NO: 20613 - protein, 17 aa, Drosophila melanogaster
EYINCDKYLEQIFSCQR

SEQ ID NO: 20614 - protein, 17 aa, Drosophila melanogaster
EYINCDKYLEQIFSCQR

SEQ ID NO: 20615 - protein, 17 aa, Drosophila melanogaster
EYINCDKYLEQIFSCQR

SEQ ID NO: 20616 - protein, 17 aa, Drosophila melanogaster
EYINCDKYLEQIFSCQR

SEQ ID NO: 20617 - protein, 17 aa, Drosophila melanogaster
EYINCDKYLEQIFSCQR

SEQ ID NO: 20618 - protein, 17 aa, Drosophila melanogaster
EYINCDKYLEQIFSCQR

SEQ ID NO: 20619 - protein, 17 aa, Drosophila melanogaster
EYINCDKYLEQIFSCQR

SEQ ID NO: 20620 - protein, 17 aa, Drosophila melanogaster
EYINCDKYLEQIFSCQR

SEQ ID NO: 20621 - protein, 17 aa, Drosophila melanogaster
EYINCDKYLEQIFSCQR

SEQ ID NO: 20622 - protein, 17 aa, Drosophila melanogaster
EYINCDKYLEQIFSCQR

SEQ ID NO: 20623 - protein, 18 aa, Drosophila melanogaster
ANAALQSTASPAPGGKSR

SEQ ID NO: 20624 - protein, 16 aa, Drosophila melanogaster
EFFLSFAKDPQMFIHR

SEQ ID NO: 20625 - protein, 16 aa, Drosophila melanogaster
EFFLSFAKDPQMFIHR

SEQ ID NO: 20626 - protein, 16 aa, Drosophila melanogaster
EFFLSFAKDPQMFIHR

SEQ ID NO: 20627 - protein, 16 aa, Drosophila melanogaster
EFFLSFAKDPQMFIHR

SEQ ID NO: 20628 - protein, 16 aa, Drosophila melanogaster
EFFLSFAKDPQMFIHR

SEQ ID NO: 20629 - protein, 10 aa, Drosophila melanogaster
AKHLAALEER

SEQ ID NO: 20630 - protein, 10 aa, Drosophila melanogaster
AKHLAALEER

SEQ ID NO: 20631 - protein, 14 aa, Drosophila melanogaster
QQFHLEQLKAAEFR

SEQ ID NO: 20632 - protein, 14 aa, Drosophila melanogaster
QQFHLEQLKAAEFR

SEQ ID NO: 20633 - protein, 14 aa, Drosophila melanogaster
QQFHLEQLKAAEFR

SEQ ID NO: 20634 - protein, 14 aa, Drosophila melanogaster
QQFHLEQLKAAEFR

SEQ ID NO: 20635 - protein, 14 aa, Drosophila melanogaster
QQFHLEQLKAAEFR

SEQ ID NO: 20636 - protein, 14 aa, Drosophila melanogaster
QQFHLEQLKAAEFR

SEQ ID NO: 20637 - protein, 14 aa, Drosophila melanogaster
QQFHLEQLKAAEFR

SEQ ID NO: 20638 - protein, 14 aa, Drosophila melanogaster
QQFHLEQLKAAEFR

SEQ ID NO: 20639 - protein, 14 aa, Drosophila melanogaster
QQFHLEQLKAAEFR

SEQ ID NO: 20640 - protein, 14 aa, Drosophila melanogaster
QQFHLEQLKAAEFR

SEQ ID NO: 20641 - protein, 14 aa, Drosophila melanogaster
QQFHLEQLKAAEFR

SEQ ID NO: 20642 - protein, 14 aa, Drosophila melanogaster
QQFHLEQLKAAEFR

SEQ ID NO: 20643 - protein, 14 aa, Drosophila melanogaster
QQFHLEQLKAAEFR

SEQ ID NO: 20644 - protein, 14 aa, Drosophila melanogaster
QQFHLEQLKAAEFR

SEQ ID NO: 20645 - protein, 14 aa, Drosophila melanogaster
QQFHLEQLKAAEFR

SEQ ID NO: 20646 - protein, 10 aa, Drosophila melanogaster
LEKLCAVLTR

SEQ ID NO: 20647 - protein, 10 aa, Drosophila melanogaster
LEKLCAVLTR

SEQ ID NO: 20648 - protein, 10 aa, Drosophila melanogaster
LEKLCAVLTR

SEQ ID NO: 20649 - protein, 10 aa, Drosophila melanogaster
LEKLCAVLTR

SEQ ID NO: 20650 - protein, 10 aa, Drosophila melanogaster
LEKLCAVLTR

SEQ ID NO: 20651 - protein, 17 aa, Drosophila melanogaster
GTGAGGGGVGSGGGSKR

SEQ ID NO: 20652 - protein, 26 aa, Drosophila melanogaster
RIDIQPAEDEDDQDEGYTTKHLAYAR

SEQ ID NO: 20653 - protein, 26 aa, Drosophila melanogaster
RIDIQPAEDEDDQDEGYTTKHLAYAR

SEQ ID NO: 20654 - protein, 17 aa, Drosophila melanogaster
GTGAGGGGVGSGGGSKR

SEQ ID NO: 20655 - protein, 10 aa, Drosophila melanogaster
GGGSKSQHER

SEQ ID NO: 20656 - protein, 16 aa, Drosophila melanogaster
HLEFLAAVLQHGKDLR

SEQ ID NO: 20657 - protein, 18 aa, Drosophila melanogaster
QKHLEFLAAVLQHGKDLR

SEQ ID NO: 20658 - protein, 16 aa, Drosophila melanogaster
HLEFLAAVLQHGKDLR

SEQ ID NO: 20659 - protein, 16 aa, Drosophila melanogaster
HLEFLAAVLQHGKDLR

SEQ ID NO: 20660 - protein, 18 aa, Drosophila melanogaster
QKHLEFLAAVLQHGKDLR

SEQ ID NO: 20661 - protein, 16 aa, Drosophila melanogaster
HLEFLAAVLQHGKDLR

SEQ ID NO: 20662 - protein, 18 aa, Drosophila melanogaster
QKHLEFLAAVLQHGKDLR

SEQ ID NO: 20663 - protein, 16 aa, Drosophila melanogaster
HLEFLAAVLQHGKDLR

SEQ ID NO: 20664 - protein, 18 aa, Drosophila melanogaster
QKHLEFLAAVLQHGKDLR

SEQ ID NO: 20665 - protein, 18 aa, Drosophila melanogaster
QKHLEFLAAVLQHGKDLR

SEQ ID NO: 20666 - protein, 16 aa, Drosophila melanogaster
HLEFLAAVLQHGKDLR

SEQ ID NO: 20667 - protein, 18 aa, Drosophila melanogaster
QKHLEFLAAVLQHGKDLR

SEQ ID NO: 20668 - protein, 16 aa, Drosophila melanogaster
HLEFLAAVLQHGKDLR

SEQ ID NO: 20669 - protein, 19 aa, Drosophila melanogaster
KELIFPHDSVESTTPVLYR

SEQ ID NO: 20670 - protein, 8 aa, Drosophila melanogaster
FLEKEVFK

SEQ ID NO: 20671 - protein, 8 aa, Drosophila melanogaster
KAFPTSHR

SEQ ID NO: 20672 - protein, 11 aa, Drosophila melanogaster
FHPEYFELIKR

SEQ ID NO: 20673 - protein, 11 aa, Drosophila melanogaster
TNANVEGTPKR

SEQ ID NO: 20674 - protein, 12 aa, Drosophila melanogaster
KPAASSGGGKQK

SEQ ID NO: 20675 - protein, 23 aa, Drosophila melanogaster
AAMEEFAAIKDEVPATIMDNHLK

SEQ ID NO: 20676 - protein, 23 aa, Drosophila melanogaster
AAMEEFAAIKDEVPATIMDNHLK

SEQ ID NO: 20677 - protein, 23 aa, Drosophila melanogaster
AAMEEFAAIKDEVPATIMDNHLK

SEQ ID NO: 20678 - protein, 9 aa, Drosophila melanogaster
KKIRDQDRN

SEQ ID NO: 20679 - protein, 9 aa, Drosophila melanogaster
KKIRDQDRN

SEQ ID NO: 20680 - protein, 12 aa, Drosophila melanogaster
RGGGSKSQHERR

SEQ ID NO: 20681 - protein, 12 aa, Drosophila melanogaster
RGGGSKSQHERR

SEQ ID NO: 20682 - protein, 7 aa, Drosophila melanogaster
KKLEIKL

SEQ ID NO: 20683 - protein, 15 aa, Drosophila melanogaster
RHCKPAVDEETFQKM

SEQ ID NO: 20684 - protein, 15 aa, Drosophila melanogaster
RHCKPAVDEETFQKM

SEQ ID NO: 20685 - protein, 15 aa, Drosophila melanogaster
RHCKPAVDEETFQKM

SEQ ID NO: 20686 - protein, 15 aa, Drosophila melanogaster
RHCKPAVDEETFQKM

SEQ ID NO: 20687 - protein, 15 aa, Drosophila melanogaster
RHCKPAVDEETFQKM

SEQ ID NO: 20688 - protein, 15 aa, Drosophila melanogaster
RHCKPAVDEETFQKM

SEQ ID NO: 20689 - protein, 15 aa, Drosophila melanogaster
RHCKPAVDEETFQKM

SEQ ID NO: 20690 - protein, 15 aa, Drosophila melanogaster
RHCKPAVDEETFQKM

SEQ ID NO: 20691 - protein, 15 aa, Drosophila melanogaster
RHCKPAVDEETFQKM

SEQ ID NO: 20692 - protein, 7 aa, Drosophila melanogaster
KFEAKKQ

SEQ ID NO: 20693 - protein, 7 aa, Drosophila melanogaster
KFEAKKQ

SEQ ID NO: 20694 - protein, 12 aa, Drosophila melanogaster
RGGGSKSQHERR

SEQ ID NO: 20695 - protein, 11 aa, Drosophila melanogaster
KRVWDSVKAKH

SEQ ID NO: 20696 - protein, 12 aa, Drosophila melanogaster
RKNAVEGESDRK

SEQ ID NO: 20697 - protein, 9 aa, Drosophila melanogaster
KAKHPELKL

SEQ ID NO: 20698 - protein, 6 aa, Drosophila melanogaster
KKALRK

SEQ ID NO: 20699 - protein, 9 aa, Drosophila melanogaster
KKSDSLCKL

SEQ ID NO: 20700 - protein, 9 aa, Drosophila melanogaster
KKSDSLCKL

SEQ ID NO: 20701 - protein, 8 aa, Drosophila melanogaster
RKGVPVRI

SEQ ID NO: 20702 - protein, 8 aa, Drosophila melanogaster
RKGVPVRI

SEQ ID NO: 20703 - protein, 8 aa, Drosophila melanogaster
RKGVPVRI

SEQ ID NO: 20704 - protein, 8 aa, Drosophila melanogaster
RKGVPVRI

SEQ ID NO: 20705 - protein, 12 aa, Drosophila melanogaster
KKEVEHQLPDKV

SEQ ID NO: 20706 - protein, 24 aa, Drosophila melanogaster
RHQGVMVGMGQKDCYVGDEAQSKR

SEQ ID NO: 20707 - protein, 11 aa, Drosophila melanogaster
KIKIVAPPERK

SEQ ID NO: 20708 - protein, 16 aa, Drosophila melanogaster
RQQFHLEQLKAAEFRA

SEQ ID NO: 20709 - protein, 16 aa, Drosophila melanogaster
RQQFHLEQLKAAEFRA

SEQ ID NO: 20710 - protein, 16 aa, Drosophila melanogaster
RQQFHLEQLKAAEFRA

SEQ ID NO: 20711 - protein, 16 aa, Drosophila melanogaster
RQQFHLEQLKAAEFRA

SEQ ID NO: 20712 - protein, 16 aa, Drosophila melanogaster
RQQFHLEQLKAAEFRA

SEQ ID NO: 20713 - protein, 16 aa, Drosophila melanogaster
RQQFHLEQLKAAEFRA

SEQ ID NO: 20714 - protein, 16 aa, Drosophila melanogaster
RQQFHLEQLKAAEFRA

SEQ ID NO: 20715 - protein, 16 aa, Drosophila melanogaster
RQQFHLEQLKAAEFRA

SEQ ID NO: 20716 - protein, 16 aa, Drosophila melanogaster
RQQFHLEQLKAAEFRA

SEQ ID NO: 20717 - protein, 16 aa, Drosophila melanogaster
RQQFHLEQLKAAEFRA

SEQ ID NO: 20718 - protein, 16 aa, Drosophila melanogaster
RQQFHLEQLKAAEFRA

SEQ ID NO: 20719 - protein, 14 aa, Drosophila melanogaster
RLLEDGKGDPNTKI

SEQ ID NO: 20720 - protein, 12 aa, Drosophila melanogaster
KAKHLAALEERK

SEQ ID NO: 20721 - protein, 12 aa, Drosophila melanogaster
KAKHLAALEERK

SEQ ID NO: 20722 - protein, 12 aa, Drosophila melanogaster
KAKHLAALEERK

SEQ ID NO: 20723 - protein, 12 aa, Drosophila melanogaster
KAKHLAALEERK

SEQ ID NO: 20724 - protein, 12 aa, Drosophila melanogaster
KAKHLAALEERK

SEQ ID NO: 20725 - protein, 9 aa, Drosophila melanogaster
KILPQKVRD

SEQ ID NO: 20726 - protein, 9 aa, Drosophila melanogaster
KILPQKVRD

SEQ ID NO: 20727 - protein, 12 aa, Drosophila melanogaster
KTHKLQDAHERE

SEQ ID NO: 20728 - protein, 12 aa, Drosophila melanogaster
KTHKLQDAHERE

SEQ ID NO: 20729 - protein, 12 aa, Drosophila melanogaster
KTHKLQDAHERE

SEQ ID NO: 20730 - protein, 12 aa, Drosophila melanogaster
KTHKLQDAHERE

SEQ ID NO: 20731 - protein, 12 aa, Drosophila melanogaster
KTHKLQDAHERE

SEQ ID NO: 20732 - protein, 12 aa, Drosophila melanogaster
KTHKLQDAHERE

SEQ ID NO: 20733 - protein, 12 aa, Drosophila melanogaster
KTHKLQDAHERE

SEQ ID NO: 20734 - protein, 12 aa, Drosophila melanogaster
KTHKLQDAHERE

SEQ ID NO: 20735 - protein, 12 aa, Drosophila melanogaster
KTHKLQDAHERE

SEQ ID NO: 20736 - protein, 12 aa, Drosophila melanogaster
KTHKLQDAHERE

SEQ ID NO: 20737 - protein, 12 aa, Drosophila melanogaster
KTHKLQDAHERE

SEQ ID NO: 20738 - protein, 12 aa, Drosophila melanogaster
KTHKLQDAHERE

SEQ ID NO: 20739 - protein, 12 aa, Drosophila melanogaster
KTHKLQDAHERE

SEQ ID NO: 20740 - protein, 12 aa, Drosophila melanogaster
KTHKLQDAHERE

SEQ ID NO: 20741 - protein, 12 aa, Drosophila melanogaster
KTHKLQDAHERE

SEQ ID NO: 20742 - protein, 10 aa, Drosophila melanogaster
RKLDATIMRK

SEQ ID NO: 20743 - protein, 10 aa, Drosophila melanogaster
RKLDATIMRK

SEQ ID NO: 20744 - protein, 10 aa, Drosophila melanogaster
RKLDATIMRK

SEQ ID NO: 20745 - protein, 10 aa, Drosophila melanogaster
RKLDATIMRK

SEQ ID NO: 20746 - protein, 10 aa, Drosophila melanogaster
RKLDATIMRK

SEQ ID NO: 20747 - protein, 6 aa, Drosophila melanogaster
RYSKRV

SEQ ID NO: 20748 - protein, 19 aa, Drosophila melanogaster
RGTGAGGGGVGSGGGSKRS

SEQ ID NO: 20749 - protein, 19 aa, Drosophila melanogaster
RGTGAGGGGVGSGGGSKRS

SEQ ID NO: 20750 - protein, 12 aa, Drosophila melanogaster
RGGGSKSQHERR

SEQ ID NO: 20751 - protein, 10 aa, Drosophila melanogaster
RKLDATIMRK

SEQ ID NO: 20752 - protein, 14 aa, Drosophila melanogaster
RLKMISANGSVERR

SEQ ID NO: 20753 - protein, 14 aa, Drosophila melanogaster
RLKMISANGSVERR

SEQ ID NO: 20754 - protein, 14 aa, Drosophila melanogaster
RLKMISANGSVERR

SEQ ID NO: 20755 - protein, 14 aa, Drosophila melanogaster
RLKMISANGSVERR

SEQ ID NO: 20756 - protein, 14 aa, Drosophila melanogaster
RLKMISANGSVERR

SEQ ID NO: 20757 - protein, 14 aa, Drosophila melanogaster
RLKMISANGSVERR

SEQ ID NO: 20758 - protein, 14 aa, Drosophila melanogaster
RLKMISANGSVERR

SEQ ID NO: 20759 - protein, 14 aa, Drosophila melanogaster
RLKMISANGSVERR

SEQ ID NO: 20760 - protein, 14 aa, Drosophila melanogaster
RLKMISANGSVERR

SEQ ID NO: 20761 - protein, 14 aa, Drosophila melanogaster
RLKMISANGSVERR

SEQ ID NO: 20762 - protein, 14 aa, Drosophila melanogaster
RLKMISANGSVERR

SEQ ID NO: 20763 - protein, 14 aa, Drosophila melanogaster
RLKMISANGSVERR

SEQ ID NO: 20764 - protein, 14 aa, Drosophila melanogaster
RLKMISANGSVERR

SEQ ID NO: 20765 - protein, 21 aa, Drosophila melanogaster
RITTVAKPVGLDPITLLQERE

SEQ ID NO: 20766 - protein, 11 aa, Drosophila melanogaster
KGKHGKGGAKA

SEQ ID NO: 20767 - protein, 6 aa, Drosophila melanogaster
KKQTRR

SEQ ID NO: 20768 - protein, 11 aa, Drosophila melanogaster
KQHKDDQMKKK

SEQ ID NO: 20769 - protein, 12 aa, Drosophila melanogaster
RLDGTTKAEDRG

SEQ ID NO: 20770 - protein, 8 aa, Drosophila melanogaster
RILPKLKA

SEQ ID NO: 20771 - protein, 16 aa, Drosophila melanogaster
RQVPPAGMPMPKPNRI

SEQ ID NO: 20772 - protein, 16 aa, Drosophila melanogaster
RQVPPAGMPMPKPNRI

SEQ ID NO: 20773 - protein, 16 aa, Drosophila melanogaster
RQVPPAGMPMPKPNRI

SEQ ID NO: 20774 - protein, 7 aa, Drosophila melanogaster
KIRDQDR

SEQ ID NO: 20775 - protein, 7 aa, Drosophila melanogaster
KIRDQDR

SEQ ID NO: 20776 - protein, 10 aa, Drosophila melanogaster
GGGSKSQHER

SEQ ID NO: 20777 - protein, 10 aa, Drosophila melanogaster
GGGSKSQHER

SEQ ID NO: 20778 - protein, 5 aa, Drosophila melanogaster
KLEIK

SEQ ID NO: 20779 - protein, 13 aa, Drosophila melanogaster
HCKPAVDEETFQK

SEQ ID NO: 20780 - protein, 13 aa, Drosophila melanogaster
HCKPAVDEETFQK

SEQ ID NO: 20781 - protein, 13 aa, Drosophila melanogaster
HCKPAVDEETFQK

SEQ ID NO: 20782 - protein, 13 aa, Drosophila melanogaster
HCKPAVDEETFQK

SEQ ID NO: 20783 - protein, 13 aa, Drosophila melanogaster
HCKPAVDEETFQK

SEQ ID NO: 20784 - protein, 13 aa, Drosophila melanogaster
HCKPAVDEETFQK

SEQ ID NO: 20785 - protein, 13 aa, Drosophila melanogaster
HCKPAVDEETFQK

SEQ ID NO: 20786 - protein, 13 aa, Drosophila melanogaster
HCKPAVDEETFQK

SEQ ID NO: 20787 - protein, 13 aa, Drosophila melanogaster
HCKPAVDEETFQK

SEQ ID NO: 20788 - protein, 5 aa, Drosophila melanogaster
FEAKK

SEQ ID NO: 20789 - protein, 5 aa, Drosophila melanogaster
FEAKK

SEQ ID NO: 20790 - protein, 10 aa, Drosophila melanogaster
GGGSKSQHER

SEQ ID NO: 20791 - protein, 9 aa, Drosophila melanogaster
RVWDSVKAK

SEQ ID NO: 20792 - protein, 10 aa, Drosophila melanogaster
KNAVEGESDR

SEQ ID NO: 20793 - protein, 7 aa, Drosophila melanogaster
AKHPELK

SEQ ID NO: 20794 - protein, 4 aa, Drosophila melanogaster
KALR

SEQ ID NO: 20795 - protein, 7 aa, Drosophila melanogaster
KSDSLCK

SEQ ID NO: 20796 - protein, 7 aa, Drosophila melanogaster
KSDSLCK

SEQ ID NO: 20797 - protein, 6 aa, Drosophila melanogaster
KGVPVR

SEQ ID NO: 20798 - protein, 6 aa, Drosophila melanogaster
KGVPVR

SEQ ID NO: 20799 - protein, 6 aa, Drosophila melanogaster
KGVPVR

SEQ ID NO: 20800 - protein, 6 aa, Drosophila melanogaster
KGVPVR

SEQ ID NO: 20801 - protein, 10 aa, Drosophila melanogaster
KEVEHQLPDK

SEQ ID NO: 20802 - protein, 22 aa, Drosophila melanogaster
HQGVMVGMGQKDCYVGDEAQSK

SEQ ID NO: 20803 - protein, 9 aa, Drosophila melanogaster
IKIVAPPER

SEQ ID NO: 20804 - protein, 14 aa, Drosophila melanogaster
QQFHLEQLKAAEFR

SEQ ID NO: 20805 - protein, 14 aa, Drosophila melanogaster
QQFHLEQLKAAEFR

SEQ ID NO: 20806 - protein, 14 aa, Drosophila melanogaster
QQFHLEQLKAAEFR

SEQ ID NO: 20807 - protein, 14 aa, Drosophila melanogaster
QQFHLEQLKAAEFR

SEQ ID NO: 20808 - protein, 14 aa, Drosophila melanogaster
QQFHLEQLKAAEFR

SEQ ID NO: 20809 - protein, 14 aa, Drosophila melanogaster
QQFHLEQLKAAEFR

SEQ ID NO: 20810 - protein, 14 aa, Drosophila melanogaster
QQFHLEQLKAAEFR

SEQ ID NO: 20811 - protein, 14 aa, Drosophila melanogaster
QQFHLEQLKAAEFR

SEQ ID NO: 20812 - protein, 14 aa, Drosophila melanogaster
QQFHLEQLKAAEFR

SEQ ID NO: 20813 - protein, 14 aa, Drosophila melanogaster
QQFHLEQLKAAEFR

SEQ ID NO: 20814 - protein, 14 aa, Drosophila melanogaster
QQFHLEQLKAAEFR

SEQ ID NO: 20815 - protein, 12 aa, Drosophila melanogaster
LLEDGKGDPNTK

SEQ ID NO: 20816 - protein, 10 aa, Drosophila melanogaster
AKHLAALEER

SEQ ID NO: 20817 - protein, 10 aa, Drosophila melanogaster
AKHLAALEER

SEQ ID NO: 20818 - protein, 10 aa, Drosophila melanogaster
AKHLAALEER

SEQ ID NO: 20819 - protein, 10 aa, Drosophila melanogaster
AKHLAALEER

SEQ ID NO: 20820 - protein, 10 aa, Drosophila melanogaster
AKHLAALEER

SEQ ID NO: 20821 - protein, 7 aa, Drosophila melanogaster
ILPQKVR

SEQ ID NO: 20822 - protein, 7 aa, Drosophila melanogaster
ILPQKVR

SEQ ID NO: 20823 - protein, 10 aa, Drosophila melanogaster
THKLQDAHER

SEQ ID NO: 20824 - protein, 10 aa, Drosophila melanogaster
THKLQDAHER

SEQ ID NO: 20825 - protein, 10 aa, Drosophila melanogaster
THKLQDAHER

SEQ ID NO: 20826 - protein, 10 aa, Drosophila melanogaster
THKLQDAHER

SEQ ID NO: 20827 - protein, 10 aa, Drosophila melanogaster
THKLQDAHER

SEQ ID NO: 20828 - protein, 10 aa, Drosophila melanogaster
THKLQDAHER

SEQ ID NO: 20829 - protein, 10 aa, Drosophila melanogaster
THKLQDAHER

SEQ ID NO: 20830 - protein, 10 aa, Drosophila melanogaster
THKLQDAHER

SEQ ID NO: 20831 - protein, 10 aa, Drosophila melanogaster
THKLQDAHER

SEQ ID NO: 20832 - protein, 10 aa, Drosophila melanogaster
THKLQDAHER

SEQ ID NO: 20833 - protein, 10 aa, Drosophila melanogaster
THKLQDAHER

SEQ ID NO: 20834 - protein, 10 aa, Drosophila melanogaster
THKLQDAHER

SEQ ID NO: 20835 - protein, 10 aa, Drosophila melanogaster
THKLQDAHER

SEQ ID NO: 20836 - protein, 10 aa, Drosophila melanogaster
THKLQDAHER

SEQ ID NO: 20837 - protein, 10 aa, Drosophila melanogaster
THKLQDAHER

SEQ ID NO: 20838 - protein, 8 aa, Drosophila melanogaster
KLDATIMR

SEQ ID NO: 20839 - protein, 8 aa, Drosophila melanogaster
KLDATIMR

SEQ ID NO: 20840 - protein, 8 aa, Drosophila melanogaster
KLDATIMR

SEQ ID NO: 20841 - protein, 8 aa, Drosophila melanogaster
KLDATIMR

SEQ ID NO: 20842 - protein, 8 aa, Drosophila melanogaster
KLDATIMR

SEQ ID NO: 20843 - protein, 4 aa, Drosophila melanogaster
YSKR

SEQ ID NO: 20844 - protein, 17 aa, Drosophila melanogaster
GTGAGGGGVGSGGGSKR

SEQ ID NO: 20845 - protein, 17 aa, Drosophila melanogaster
GTGAGGGGVGSGGGSKR

SEQ ID NO: 20846 - protein, 10 aa, Drosophila melanogaster
GGGSKSQHER

SEQ ID NO: 20847 - protein, 8 aa, Drosophila melanogaster
KLDATIMR

SEQ ID NO: 20848 - protein, 12 aa, Drosophila melanogaster
LKMISANGSVER

SEQ ID NO: 20849 - protein, 12 aa, Drosophila melanogaster
LKMISANGSVER

SEQ ID NO: 20850 - protein, 12 aa, Drosophila melanogaster
LKMISANGSVER

SEQ ID NO: 20851 - protein, 12 aa, Drosophila melanogaster
LKMISANGSVER

SEQ ID NO: 20852 - protein, 12 aa, Drosophila melanogaster
LKMISANGSVER

SEQ ID NO: 20853 - protein, 12 aa, Drosophila melanogaster
LKMISANGSVER

SEQ ID NO: 20854 - protein, 12 aa, Drosophila melanogaster
LKMISANGSVER

SEQ ID NO: 20855 - protein, 12 aa, Drosophila melanogaster
LKMISANGSVER

SEQ ID NO: 20856 - protein, 12 aa, Drosophila melanogaster
LKMISANGSVER

SEQ ID NO: 20857 - protein, 12 aa, Drosophila melanogaster
LKMISANGSVER

SEQ ID NO: 20858 - protein, 12 aa, Drosophila melanogaster
LKMISANGSVER

SEQ ID NO: 20859 - protein, 12 aa, Drosophila melanogaster
LKMISANGSVER

SEQ ID NO: 20860 - protein, 12 aa, Drosophila melanogaster
LKMISANGSVER

SEQ ID NO: 20861 - protein, 19 aa, Drosophila melanogaster
ITTVAKPVGLDPITLLQER

SEQ ID NO: 20862 - protein, 9 aa, Drosophila melanogaster
GKHGKGGAK

SEQ ID NO: 20863 - protein, 4 aa, Drosophila melanogaster
KQTR

SEQ ID NO: 20864 - protein, 9 aa, Drosophila melanogaster
QHKDDQMKK

SEQ ID NO: 20865 - protein, 10 aa, Drosophila melanogaster
LDGTTKAEDR

SEQ ID NO: 20866 - protein, 6 aa, Drosophila melanogaster
ILPKLK

SEQ ID NO: 20867 - protein, 14 aa, Drosophila melanogaster
QVPPAGMPMPKPNR

SEQ ID NO: 20868 - protein, 14 aa, Drosophila melanogaster
QVPPAGMPMPKPNR

SEQ ID NO: 20869 - protein, 14 aa, Drosophila melanogaster
QVPPAGMPMPKPNR

SEQ ID NO: 20870 - protein, 9 aa, Drosophila melanogaster
RKFSSFFKS

SEQ ID NO: 20871 - protein, 30 aa, Drosophila melanogaster; identical to SEQ ID NO: 19112

SEQ ID NO: 20872 - protein, 16 aa, Drosophila melanogaster
RTHTTQETDGFQVKRP

SEQ ID NO: 20873 - protein, 30 aa, Drosophila melanogaster; identical to SEQ ID NO: 19112

SEQ ID NO: 20874 - protein, 34 aa, Drosophila melanogaster; identical to SEQ ID NO: 19121

SEQ ID NO: 20875 - protein, 16 aa, Drosophila melanogaster
RTHTTQETDGFQVKRP

SEQ ID NO: 20876 - protein, 17 aa, Drosophila melanogaster
KIHETVDTINQMKTNRE

SEQ ID NO: 20877 - protein, 17 aa, Drosophila melanogaster
KIHETVDTINQMKTNRE

SEQ ID NO: 20878 - protein, 17 aa, Drosophila melanogaster
KIHETVDTINQMKTNRE

SEQ ID NO: 20879 - protein, 17 aa, Drosophila melanogaster
KIHETVDTINQMKTNRE

SEQ ID NO: 20880 - protein, 17 aa, Drosophila melanogaster
KIHETVDTINQMKTNRE

SEQ ID NO: 20881 - protein, 17 aa, Drosophila melanogaster
KIHETVDTINQMKTNRE

SEQ ID NO: 20882 - protein, 17 aa, Drosophila melanogaster
KIHETVDTINQMKTNRE

SEQ ID NO: 20883 - protein, 18 aa, Drosophila melanogaster
REFFLSFAKDPQMFIHRW

SEQ ID NO: 20884 - protein, 17 aa, Drosophila melanogaster
KIHETVDTINQMKTNRE

SEQ ID NO: 20885 - protein, 17 aa, Drosophila melanogaster
KIHETVDTINQMKTNRE

SEQ ID NO: 20886 - protein, 17 aa, Drosophila melanogaster
KIHETVDTINQMKTNRE

SEQ ID NO: 20887 - protein, 18 aa, Drosophila melanogaster
REFFLSFAKDPQMFIHRW

SEQ ID NO: 20888 - protein, 17 aa, Drosophila melanogaster
KIHETVDTINQMKTNRE

SEQ ID NO: 20889 - protein, 9 aa, Drosophila melanogaster
KILPQKVRD

SEQ ID NO: 20890 - protein, 9 aa, Drosophila melanogaster
KILPQKVRD

SEQ ID NO: 20891 - protein, 9 aa, Drosophila melanogaster
KILPQKVRD

SEQ ID NO: 20892 - protein, 11 aa, Drosophila melanogaster
RMKFAEIPQRL

SEQ ID NO: 20893 - protein, 19 aa, Drosophila melanogaster
RGTGAGGGGVGSGGGSKRS

SEQ ID NO: 20894 - protein, 19 aa, Drosophila melanogaster
RGTGAGGGGVGSGGGSKRS

SEQ ID NO: 20895 - protein, 11 aa, Drosophila melanogaster
KIKIVAPPERK

SEQ ID NO: 20896 - protein, 11 aa, Drosophila melanogaster
KIKIVAPPERK

SEQ ID NO: 20897 - protein, 11 aa, Drosophila melanogaster
KIKIVAPPERK

SEQ ID NO: 20898 - protein, 16 aa, Drosophila melanogaster
RMQKEITALAPSTMKI

SEQ ID NO: 20899 - protein, 15 aa, Drosophila melanogaster
KEITALAPSTMKIKI

SEQ ID NO: 20900 - protein, 15 aa, Drosophila melanogaster
KEITALAPSTMKIKI

SEQ ID NO: 20901 - protein, 15 aa, Drosophila melanogaster
KAKLESSPGSAAVRR

SEQ ID NO: 20902 - protein, 15 aa, Drosophila melanogaster
KAKLESSPGSAAVRR

SEQ ID NO: 20903 - protein, 13 aa, Drosophila melanogaster
KWVPIASASEKKA

SEQ ID NO: 20904 - protein, 11 aa, Drosophila melanogaster
RVMQAVDKVRH

SEQ ID NO: 20905 - protein, 11 aa, Drosophila melanogaster
RVMQAVDKVRH

SEQ ID NO: 20906 - protein, 9 aa, Drosophila melanogaster
RAKDDIKRV

SEQ ID NO: 20907 - protein, 11 aa, Drosophila melanogaster
RMFQLLPSKKI

SEQ ID NO: 20908 - protein, 7 aa, Drosophila melanogaster
RKFLEKE

SEQ ID NO: 20909 - protein, 10 aa, Drosophila melanogaster
KKAFPTSHRT

SEQ ID NO: 20910 - protein, 10 aa, Drosophila melanogaster
KKAFPTSHRT

SEQ ID NO: 20911 - protein, 12 aa, Drosophila melanogaster
KIQNFLNDKEKY

SEQ ID NO: 20912 - protein, 16 aa, Drosophila melanogaster
KYKEILENSENFNTRL

SEQ ID NO: 20913 - protein, 16 aa, Drosophila melanogaster
KYKEILENSENFNTRL

SEQ ID NO: 20914 - protein, 16 aa, Drosophila melanogaster
KYKEILENSENFNTRL

SEQ ID NO: 20915 - protein, 16 aa, Drosophila melanogaster
KYKEILENSENFNTRL

SEQ ID NO: 20916 - protein, 16 aa, Drosophila melanogaster
KYKEILENSENFNTRL

SEQ ID NO: 20917 - protein, 16 aa, Drosophila melanogaster
KYKEILENSENFNTRL

SEQ ID NO: 20918 - protein, 12 aa, Drosophila melanogaster
KIQNFLNDKEKY

SEQ ID NO: 20919 - protein, 16 aa, Drosophila melanogaster
KYKEILENSENFNTRL

SEQ ID NO: 20920 - protein, 8 aa, Drosophila melanogaster
RKGGGNRR

SEQ ID NO: 20921 - protein, 12 aa, Drosophila melanogaster
RKNAVEGESDRK

SEQ ID NO: 20922 - protein, 13 aa, Drosophila melanogaster
RRKNAVEGESDRK

SEQ ID NO: 20923 - protein, 12 aa, Drosophila melanogaster
RKNAVEGESDRK

SEQ ID NO: 20924 - protein, 12 aa, Drosophila melanogaster
RKNAVEGESDRK

SEQ ID NO: 20925 - protein, 12 aa, Drosophila melanogaster
RKNAVEGESDRK

SEQ ID NO: 20926 - protein, 13 aa, Drosophila melanogaster
RKNAVEGESDRKR

SEQ ID NO: 20927 - protein, 13 aa, Drosophila melanogaster
RRKNAVEGESDRK

SEQ ID NO: 20928 - protein, 12 aa, Drosophila melanogaster
RKNAVEGESDRK

SEQ ID NO: 20929 - protein, 13 aa, Drosophila melanogaster
RRKNAVEGESDRK

SEQ ID NO: 20930 - protein, 8 aa, Drosophila melanogaster
RKGGGNRR

SEQ ID NO: 20931 - protein, 13 aa, Drosophila melanogaster
RKNAVEGESDRKR

SEQ ID NO: 20932 - protein, 12 aa, Drosophila melanogaster
RKNAVEGESDRK

SEQ ID NO: 20933 - protein, 8 aa, Drosophila melanogaster
RKGGGNRR

SEQ ID NO: 20934 - protein, 12 aa, Drosophila melanogaster
RKNAVEGESDRK

SEQ ID NO: 20935 - protein, 12 aa, Drosophila melanogaster
RKNAVEGESDRK

SEQ ID NO: 20936 - protein, 13 aa, Drosophila melanogaster
RRKNAVEGESDRK

SEQ ID NO: 20937 - protein, 12 aa, Drosophila melanogaster
RKNAVEGESDRK

SEQ ID NO: 20938 - protein, 13 aa, Drosophila melanogaster
RRKNAVEGESDRK

SEQ ID NO: 20939 - protein, 8 aa, Drosophila melanogaster
RKGGGNRR

SEQ ID NO: 20940 - protein, 13 aa, Drosophila melanogaster
RRKNAVEGESDRK

SEQ ID NO: 20941 - protein, 12 aa, Drosophila melanogaster
RKNAVEGESDRK

SEQ ID NO: 20942 - protein, 12 aa, Drosophila melanogaster
RKNAVEGESDRK

SEQ ID NO: 20943 - protein, 8 aa, Drosophila melanogaster
RKGGGNRR

SEQ ID NO: 20944 - protein, 8 aa, Drosophila melanogaster
RKGGGNRR

SEQ ID NO: 20945 - protein, 18 aa, Drosophila melanogaster
KKTNMPEELVSCSDCGRS

SEQ ID NO: 20946 - protein, 18 aa, Drosophila melanogaster
KKTNMPEELVSCSDCGRS

SEQ ID NO: 20947 - protein, 8 aa, Drosophila melanogaster
RKGGGNRR

SEQ ID NO: 20948 - protein, 12 aa, Drosophila melanogaster
RKNAVEGESDRK

SEQ ID NO: 20949 - protein, 12 aa, Drosophila melanogaster
RKNAVEGESDRK

SEQ ID NO: 20950 - protein, 12 aa, Drosophila melanogaster
RKNAVEGESDRK

SEQ ID NO: 20951 - protein, 7 aa, Drosophila melanogaster
RKKCSRP

SEQ ID NO: 20952 - protein, 7 aa, Drosophila melanogaster
RKKCSRP

SEQ ID NO: 20953 - protein, 7 aa, Drosophila melanogaster
RKKCSRP

SEQ ID NO: 20954 - protein, 7 aa, Drosophila melanogaster
RKKCSRP

SEQ ID NO: 20955 - protein, 7 aa, Drosophila melanogaster
RKKCSRP

SEQ ID NO: 20956 - protein, 13 aa, Drosophila melanogaster
RRKNAVEGESDRK

SEQ ID NO: 20957 - protein, 13 aa, Drosophila melanogaster
RRKNAVEGESDRK

SEQ ID NO: 20958 - protein, 13 aa, Drosophila melanogaster
RRKNAVEGESDRK

SEQ ID NO: 20959 - protein, 13 aa, Drosophila melanogaster
RRKNAVEGESDRK

SEQ ID NO: 20960 - protein, 12 aa, Drosophila melanogaster
RKNAVEGESDRK

SEQ ID NO: 20961 - protein, 13 aa, Drosophila melanogaster
RRKNAVEGESDRK

SEQ ID NO: 20962 - protein, 13 aa, Drosophila melanogaster
RRKNAVEGESDRK

SEQ ID NO: 20963 - protein, 13 aa, Drosophila melanogaster
RRKNAVEGESDRK

SEQ ID NO: 20964 - protein, 13 aa, Drosophila melanogaster
RRKNAVEGESDRK

SEQ ID NO: 20965 - protein, 12 aa, Drosophila melanogaster
RKNAVEGESDRK

SEQ ID NO: 20966 - protein, 13 aa, Drosophila melanogaster
RRKNAVEGESDRK

SEQ ID NO: 20967 - protein, 12 aa, Drosophila melanogaster
RKNAVEGESDRK

SEQ ID NO: 20968 - protein, 13 aa, Drosophila melanogaster
RRKNAVEGESDRK

SEQ ID NO: 20969 - protein, 13 aa, Drosophila melanogaster
RRKNAVEGESDRK

SEQ ID NO: 20970 - protein, 13 aa, Drosophila melanogaster
RRKNAVEGESDRK

SEQ ID NO: 20971 - protein, 13 aa, Drosophila melanogaster
RRKNAVEGESDRK

SEQ ID NO: 20972 - protein, 12 aa, Drosophila melanogaster
RKNAVEGESDRK

SEQ ID NO: 20973 - protein, 18 aa, Drosophila melanogaster
KKTNMPEELVSCSDCGRS

SEQ ID NO: 20974 - protein, 12 aa, Drosophila melanogaster
RKNAVEGESDRK

SEQ ID NO: 20975 - protein, 12 aa, Drosophila melanogaster
RKNAVEGESDRK

SEQ ID NO: 20976 - protein, 12 aa, Drosophila melanogaster
RKNAVEGESDRK

SEQ ID NO: 20977 - protein, 12 aa, Drosophila melanogaster
RKNAVEGESDRK

SEQ ID NO: 20978 - protein, 18 aa, Drosophila melanogaster
KKTNMPEELVSCSDCGRS

SEQ ID NO: 20979 - protein, 12 aa, Drosophila melanogaster
RKNAVEGESDRK

SEQ ID NO: 20980 - protein, 12 aa, Drosophila melanogaster
RKNAVEGESDRK

SEQ ID NO: 20981 - protein, 12 aa, Drosophila melanogaster
RKNAVEGESDRK

SEQ ID NO: 20982 - protein, 12 aa, Drosophila melanogaster
RKNAVEGESDRK

SEQ ID NO: 20983 - protein, 13 aa, Drosophila melanogaster
RKNAVEGESDRKR

SEQ ID NO: 20984 - protein, 13 aa, Drosophila melanogaster
RKNAVEGESDRKR

SEQ ID NO: 20985 - protein, 13 aa, Drosophila melanogaster
RTNANVEGTPKRG

SEQ ID NO: 20986 - protein, 13 aa, Drosophila melanogaster
RTNANVEGTPKRG

SEQ ID NO: 20987 - protein, 13 aa, Drosophila melanogaster
RTNANVEGTPKRG

SEQ ID NO: 20988 - protein, 13 aa, Drosophila melanogaster
RTNANVEGTPKRG

SEQ ID NO: 20989 - protein, 14 aa, Drosophila melanogaster
RRTNANVEGTPKRG

SEQ ID NO: 20990 - protein, 13 aa, Drosophila melanogaster
RTNANVEGTPKRG

SEQ ID NO: 20991 - protein, 13 aa, Drosophila melanogaster
RTNANVEGTPKRG

SEQ ID NO: 20992 - protein, 13 aa, Drosophila melanogaster
RTNANVEGTPKRG

SEQ ID NO: 20993 - protein, 13 aa, Drosophila melanogaster
RTNANVEGTPKRG

SEQ ID NO: 20994 - protein, 14 aa, Drosophila melanogaster
RRTNANVEGTPKRG

SEQ ID NO: 20995 - protein, 14 aa, Drosophila melanogaster
RRTNANVEGTPKRG

SEQ ID NO: 20996 - protein, 14 aa, Drosophila melanogaster
RRTNANVEGTPKRG

SEQ ID NO: 20997 - protein, 14 aa, Drosophila melanogaster
RRTNANVEGTPKRG

SEQ ID NO: 20998 - protein, 14 aa, Drosophila melanogaster
RRTNANVEGTPKRG

SEQ ID NO: 20999 - protein, 14 aa, Drosophila melanogaster
RRTNANVEGTPKRG

SEQ ID NO: 21000 - protein, 13 aa, Drosophila melanogaster
RTNANVEGTPKRG

SEQ ID NO: 21001 - protein, 13 aa, Drosophila melanogaster
RKNAVEGESDRKR

SEQ ID NO: 21002 - protein, 14 aa, Drosophila melanogaster
RRTNANVEGTPKRG

SEQ ID NO: 21003 - protein, 14 aa, Drosophila melanogaster
RRTNANVEGTPKRG

SEQ ID NO: 21004 - protein, 13 aa, Drosophila melanogaster
RTNANVEGTPKRG

SEQ ID NO: 21005 - protein, 13 aa, Drosophila melanogaster
RTNANVEGTPKRG

SEQ ID NO: 21006 - protein, 14 aa, Drosophila melanogaster
RRTNANVEGTPKRG

SEQ ID NO: 21007 - protein, 14 aa, Drosophila melanogaster
RRTNANVEGTPKRG

SEQ ID NO: 21008 - protein, 14 aa, Drosophila melanogaster
RRTNANVEGTPKRG

SEQ ID NO: 21009 - protein, 14 aa, Drosophila melanogaster
RRTNANVEGTPKRG

SEQ ID NO: 21010 - protein, 12 aa, Drosophila melanogaster
RKNAVEGESDRK

SEQ ID NO: 21011 - protein, 12 aa, Drosophila melanogaster
RKNAVEGESDRK

SEQ ID NO: 21012 - protein, 14 aa, Drosophila melanogaster
RRTNANVEGTPKRG

SEQ ID NO: 21013 - protein, 12 aa, Drosophila melanogaster
RKNAVEGESDRK

SEQ ID NO: 21014 - protein, 14 aa, Drosophila melanogaster
RRTNANVEGTPKRG

SEQ ID NO: 21015 - protein, 14 aa, Drosophila melanogaster
RRTNANVEGTPKRG

SEQ ID NO: 21016 - protein, 13 aa, Drosophila melanogaster
RKNAVEGESDRKR

SEQ ID NO: 21017 - protein, 14 aa, Drosophila melanogaster
RRTNANVEGTPKRG

SEQ ID NO: 21018 - protein, 14 aa, Drosophila melanogaster
RRTNANVEGTPKRG

SEQ ID NO: 21019 - protein, 13 aa, Drosophila melanogaster
RTNANVEGTPKRG

SEQ ID NO: 21020 - protein, 13 aa, Drosophila melanogaster
RKNAVEGESDRKR

SEQ ID NO: 21021 - protein, 14 aa, Drosophila melanogaster
RRTNANVEGTPKRG

SEQ ID NO: 21022 - protein, 14 aa, Drosophila melanogaster
RRTNANVEGTPKRG

SEQ ID NO: 21023 - protein, 13 aa, Drosophila melanogaster
RKNAVEGESDRKR

SEQ ID NO: 21024 - protein, 14 aa, Drosophila melanogaster
RRTNANVEGTPKRG

SEQ ID NO: 21025 - protein, 12 aa, Drosophila melanogaster
RKNAVEGESDRK

SEQ ID NO: 21026 - protein, 13 aa, Drosophila melanogaster
RTNANVEGTPKRG

SEQ ID NO: 21027 - protein, 14 aa, Drosophila melanogaster
RRTNANVEGTPKRG

SEQ ID NO: 21028 - protein, 13 aa, Drosophila melanogaster
RTNANVEGTPKRG

SEQ ID NO: 21029 - protein, 13 aa, Drosophila melanogaster
RRKNAVEGESDRK

SEQ ID NO: 21030 - protein, 14 aa, Drosophila melanogaster
RRTNANVEGTPKRG

SEQ ID NO: 21031 - protein, 14 aa, Drosophila melanogaster
RRTNANVEGTPKRG

SEQ ID NO: 21032 - protein, 13 aa, Drosophila melanogaster
RTNANVEGTPKRG

SEQ ID NO: 21033 - protein, 13 aa, Drosophila melanogaster
RTNANVEGTPKRG

SEQ ID NO: 21034 - protein, 13 aa, Drosophila melanogaster
RTNANVEGTPKRG

SEQ ID NO: 21035 - protein, 14 aa, Drosophila melanogaster
RRTNANVEGTPKRG

SEQ ID NO: 21036 - protein, 14 aa, Drosophila melanogaster
RRTNANVEGTPKRG

SEQ ID NO: 21037 - protein, 14 aa, Drosophila melanogaster
RRTNANVEGTPKRG

SEQ ID NO: 21038 - protein, 14 aa, Drosophila melanogaster
RRTNANVEGTPKRG

SEQ ID NO: 21039 - protein, 14 aa, Drosophila melanogaster
RRTNANVEGTPKRG

SEQ ID NO: 21040 - protein, 14 aa, Drosophila melanogaster
RRTNANVEGTPKRG

SEQ ID NO: 21041 - protein, 14 aa, Drosophila melanogaster
RRTNANVEGTPKRG

SEQ ID NO: 21042 - protein, 14 aa, Drosophila melanogaster
RRTNANVEGTPKRG

SEQ ID NO: 21043 - protein, 13 aa, Drosophila melanogaster
RKNAVEGESDRKR

SEQ ID NO: 21044 - protein, 13 aa, Drosophila melanogaster
RTNANVEGTPKRG

SEQ ID NO: 21045 - protein, 12 aa, Drosophila melanogaster
RKNAVEGESDRK

SEQ ID NO: 21046 - protein, 13 aa, Drosophila melanogaster
RRKNAVEGESDRK

SEQ ID NO: 21047 - protein, 14 aa, Drosophila melanogaster
RRTNANVEGTPKRG

SEQ ID NO: 21048 - protein, 13 aa, Drosophila melanogaster
RTNANVEGTPKRG

SEQ ID NO: 21049 - protein, 14 aa, Drosophila melanogaster
RRTNANVEGTPKRG

SEQ ID NO: 21050 - protein, 14 aa, Drosophila melanogaster
RRTNANVEGTPKRG

SEQ ID NO: 21051 - protein, 13 aa, Drosophila melanogaster
RRKNAVEGESDRK

SEQ ID NO: 21052 - protein, 13 aa, Drosophila melanogaster
RRKNAVEGESDRK

SEQ ID NO: 21053 - protein, 12 aa, Drosophila melanogaster
RKNAVEGESDRK

SEQ ID NO: 21054 - protein, 14 aa, Drosophila melanogaster
RRTNANVEGTPKRG

SEQ ID NO: 21055 - protein, 14 aa, Drosophila melanogaster
RRTNANVEGTPKRG

SEQ ID NO: 21056 - protein, 13 aa, Drosophila melanogaster
RRKNAVEGESDRK

SEQ ID NO: 21057 - protein, 13 aa, Drosophila melanogaster
RTNANVEGTPKRG

SEQ ID NO: 21058 - protein, 14 aa, Drosophila melanogaster
RRTNANVEGTPKRG

SEQ ID NO: 21059 - protein, 14 aa, Drosophila melanogaster
RRTNANVEGTPKRG

SEQ ID NO: 21060 - protein, 14 aa, Drosophila melanogaster
RRTNANVEGTPKRG

SEQ ID NO: 21061 - protein, 14 aa, Drosophila melanogaster
RRTNANVEGTPKRG

SEQ ID NO: 21062 - protein, 14 aa, Drosophila melanogaster
RRTNANVEGTPKRG

SEQ ID NO: 21063 - protein, 23 aa, Drosophila melanogaster
RDIAQPSPYCDFCLGDQRENKKT

SEQ ID NO: 21064 - protein, 23 aa, Drosophila melanogaster
RDIAQPSPYCDFCLGDQRENKKT

SEQ ID NO: 21065 - protein, 14 aa, Drosophila melanogaster
RRTNANVEGTPKRG

SEQ ID NO: 21066 - protein, 14 aa, Drosophila melanogaster
RRTNANVEGTPKRG

SEQ ID NO: 21067 - protein, 14 aa, Drosophila melanogaster
RRTNANVEGTPKRG

SEQ ID NO: 21068 - protein, 14 aa, Drosophila melanogaster
RRTNANVEGTPKRG

SEQ ID NO: 21069 - protein, 13 aa, Drosophila melanogaster
RTNANVEGTPKRG

SEQ ID NO: 21070 - protein, 8 aa, Drosophila melanogaster
RKGGGNRR

SEQ ID NO: 21071 - protein, 13 aa, Drosophila melanogaster
RTNANVEGTPKRG

SEQ ID NO: 21072 - protein, 14 aa, Drosophila melanogaster
RRTNANVEGTPKRG

SEQ ID NO: 21073 - protein, 14 aa, Drosophila melanogaster
RRTNANVEGTPKRG

SEQ ID NO: 21074 - protein, 13 aa, Drosophila melanogaster
RTNANVEGTPKRG

SEQ ID NO: 21075 - protein, 14 aa, Drosophila melanogaster
RRTNANVEGTPKRG

SEQ ID NO: 21076 - protein, 14 aa, Drosophila melanogaster
RRTNANVEGTPKRG

SEQ ID NO: 21077 - protein, 14 aa, Drosophila melanogaster
RRTNANVEGTPKRG

SEQ ID NO: 21078 - protein, 13 aa, Drosophila melanogaster
RTNANVEGTPKRG

SEQ ID NO: 21079 - protein, 13 aa, Drosophila melanogaster
RTNANVEGTPKRG

SEQ ID NO: 21080 - protein, 10 aa, Drosophila melanogaster
RGRKGGGNRR

SEQ ID NO: 21081 - protein, 13 aa, Drosophila melanogaster
RTNANVEGTPKRG

SEQ ID NO: 21082 - protein, 8 aa, Drosophila melanogaster
RKGGGNRR

SEQ ID NO: 21083 - protein, 14 aa, Drosophila melanogaster
RRTNANVEGTPKRG

SEQ ID NO: 21084 - protein, 13 aa, Drosophila melanogaster
RTNANVEGTPKRG

SEQ ID NO: 21085 - protein, 14 aa, Drosophila melanogaster
RRTNANVEGTPKRG

SEQ ID NO: 21086 - protein, 14 aa, Drosophila melanogaster
RRTNANVEGTPKRG

SEQ ID NO: 21087 - protein, 14 aa, Drosophila melanogaster
RRTNANVEGTPKRG

SEQ ID NO: 21088 - protein, 14 aa, Drosophila melanogaster
RRTNANVEGTPKRG

SEQ ID NO: 21089 - protein, 13 aa, Drosophila melanogaster
RTNANVEGTPKRG

SEQ ID NO: 21090 - protein, 14 aa, Drosophila melanogaster
RRTNANVEGTPKRG

SEQ ID NO: 21091 - protein, 13 aa, Drosophila melanogaster
RTNANVEGTPKRG

SEQ ID NO: 21092 - protein, 8 aa, Drosophila melanogaster
RKGGGNRR

SEQ ID NO: 21093 - protein, 14 aa, Drosophila melanogaster
RRTNANVEGTPKRG

SEQ ID NO: 21094 - protein, 8 aa, Drosophila melanogaster
RKGGGNRR

SEQ ID NO: 21095 - protein, 14 aa, Drosophila melanogaster
RRTNANVEGTPKRG

SEQ ID NO: 21096 - protein, 8 aa, Drosophila melanogaster
RKGGGNRR

SEQ ID NO: 21097 - protein, 14 aa, Drosophila melanogaster
RRTNANVEGTPKRG

SEQ ID NO: 21098 - protein, 8 aa, Drosophila melanogaster
RKGGGNRR

SEQ ID NO: 21099 - protein, 8 aa, Drosophila melanogaster
RKGGGNRR

SEQ ID NO: 21100 - protein, 14 aa, Drosophila melanogaster
RRTNANVEGTPKRG

SEQ ID NO: 21101 - protein, 13 aa, Drosophila melanogaster
RTNANVEGTPKRG

SEQ ID NO: 21102 - protein, 14 aa, Drosophila melanogaster
RRTNANVEGTPKRG

SEQ ID NO: 21103 - protein, 13 aa, Drosophila melanogaster
RTNANVEGTPKRG

SEQ ID NO: 21104 - protein, 18 aa, Drosophila melanogaster
KKTNMPEELVSCSDCGRS

SEQ ID NO: 21105 - protein, 18 aa, Drosophila melanogaster
KKTNMPEELVSCSDCGRS

SEQ ID NO: 21106 - protein, 18 aa, Drosophila melanogaster
KKTNMPEELVSCSDCGRS

SEQ ID NO: 21107 - protein, 18 aa, Drosophila melanogaster
KKTNMPEELVSCSDCGRS

SEQ ID NO: 21108 - protein, 10 aa, Drosophila melanogaster
RNNKAQLARM

SEQ ID NO: 21109 - protein, 10 aa, Drosophila melanogaster
RNNKAQLARM

SEQ ID NO: 21110 - protein, 10 aa, Drosophila melanogaster
RNNKAQLARM

SEQ ID NO: 21111 - protein, 10 aa, Drosophila melanogaster
RNNKAQLARM

SEQ ID NO: 21112 - protein, 10 aa, Drosophila melanogaster
RNNKAQLARM

SEQ ID NO: 21113 - protein, 10 aa, Drosophila melanogaster
RNNKAQLARM

SEQ ID NO: 21114 - protein, 10 aa, Drosophila melanogaster
RNNKAQLARM

SEQ ID NO: 21115 - protein, 10 aa, Drosophila melanogaster
RNNKAQLARM

SEQ ID NO: 21116 - protein, 7 aa, Drosophila melanogaster
KKILQRI

SEQ ID NO: 21117 - protein, 7 aa, Drosophila melanogaster
KKILQRI

SEQ ID NO: 21118 - protein, 8 aa, Drosophila melanogaster
KKEEEGKR

SEQ ID NO: 21119 - protein, 9 aa, Drosophila melanogaster
KKEEEGKRL

SEQ ID NO: 21120 - protein, 9 aa, Drosophila melanogaster
KKEEEGKRL

SEQ ID NO: 21121 - protein, 17 aa, Drosophila melanogaster
KIQWKYMIIDEGHRMKN

SEQ ID NO: 21122 - protein, 9 aa, Drosophila melanogaster
RKLIDQKKD

SEQ ID NO: 21123 - protein, 7 aa, Drosophila melanogaster
RIEKERM

SEQ ID NO: 21124 - protein, 7 aa, Drosophila melanogaster
RIEKERM

SEQ ID NO: 21125 - protein, 7 aa, Drosophila melanogaster
RIEKERM

SEQ ID NO: 21126 - protein, 7 aa, Drosophila melanogaster
RIEKERM

SEQ ID NO: 21127 - protein, 7 aa, Drosophila melanogaster
KKEQERI

SEQ ID NO: 21128 - protein, 7 aa, Drosophila melanogaster
KKEQERI

SEQ ID NO: 21129 - protein, 7 aa, Drosophila melanogaster
KKEQERI

SEQ ID NO: 21130 - protein, 7 aa, Drosophila melanogaster
KKILQRI

SEQ ID NO: 21131 - protein, 7 aa, Drosophila melanogaster
KKILQRI

SEQ ID NO: 21132 - protein, 14 aa, Drosophila melanogaster
RTLSEPFMKLPSRQ

SEQ ID NO: 21133 - protein, 14 aa, Drosophila melanogaster
RTLSEPFMKLPSRQ

SEQ ID NO: 21134 - protein, 14 aa, Drosophila melanogaster
RTLSEPFMKLPSRQ

SEQ ID NO: 21135 - protein, 13 aa, Drosophila melanogaster
RVHVVEQCTGKKL

SEQ ID NO: 21136 - protein, 13 aa, Drosophila melanogaster
RVHVVEQCTGKKL

SEQ ID NO: 21137 - protein, 13 aa, Drosophila melanogaster
RVHVVEQCTGKKL

SEQ ID NO: 21138 - protein, 7 aa, Drosophila melanogaster
RIEKERM

SEQ ID NO: 21139 - protein, 18 aa, Drosophila melanogaster
KAQATGNDEDAKDLITKA

SEQ ID NO: 21140 - protein, 17 aa, Drosophila melanogaster
RAIDSMEEKGLQEDPRY

SEQ ID NO: 21141 - protein, 7 aa, Drosophila melanogaster
RIEKERM

SEQ ID NO: 21142 - protein, 7 aa, Drosophila melanogaster
RIEKERM

SEQ ID NO: 21143 - protein, 7 aa, Drosophila melanogaster
RIEKERM

SEQ ID NO: 21144 - protein, 13 aa, Drosophila melanogaster
RKKEDEEIHPGRE

SEQ ID NO: 21145 - protein, 13 aa, Drosophila melanogaster
RKKEDEEIHPGRE

SEQ ID NO: 21146 - protein, 12 aa, Drosophila melanogaster
RSEEEIEIFKRM

SEQ ID NO: 21147 - protein, 13 aa, Drosophila melanogaster
RKKEDEEIHPGRE

SEQ ID NO: 21148 - protein, 13 aa, Drosophila melanogaster
RKKEDEEIHPGRE

SEQ ID NO: 21149 - protein, 13 aa, Drosophila melanogaster
RKKEDEEIHPGRE

SEQ ID NO: 21150 - protein, 13 aa, Drosophila melanogaster
RKKEDEEIHPGRE

SEQ ID NO: 21151 - protein, 13 aa, Drosophila melanogaster
RKKEDEEIHPGRE

SEQ ID NO: 21152 - protein, 12 aa, Drosophila melanogaster
RSEEEIEIFKRM

SEQ ID NO: 21153 - protein, 13 aa, Drosophila melanogaster
RKKEDEEIHPGRE

SEQ ID NO: 21154 - protein, 12 aa, Drosophila melanogaster
RSEEEIEIFKRM

SEQ ID NO: 21155 - protein, 13 aa, Drosophila melanogaster
RKKEDEEIHPGRE

SEQ ID NO: 21156 - protein, 13 aa, Drosophila melanogaster
RKKEDEEIHPGRE

SEQ ID NO: 21157 - protein, 12 aa, Drosophila melanogaster
RSEEEIEIFKRM

SEQ ID NO: 21158 - protein, 13 aa, Drosophila melanogaster
RKKEDEEIHPGRE

SEQ ID NO: 21159 - protein, 13 aa, Drosophila melanogaster
RKKEDEEIHPGRE

SEQ ID NO: 21160 - protein, 12 aa, Drosophila melanogaster
RSEEEIEIFKRM

SEQ ID NO: 21161 - protein, 15 aa, Drosophila melanogaster
KVKTDVDMHETPSRG

SEQ ID NO: 21162 - protein, 12 aa, Drosophila melanogaster
RGGGSKSQHERR

SEQ ID NO: 21163 - protein, 12 aa, Drosophila melanogaster
RGGGSKSQHERR

SEQ ID NO: 21164 - protein, 15 aa, Drosophila melanogaster
RHCKPAVDEETFQKM

SEQ ID NO: 21165 - protein, 15 aa, Drosophila melanogaster
RHCKPAVDEETFQKM

SEQ ID NO: 21166 - protein, 16 aa, Drosophila melanogaster
RMVESSEAFQEELKRH

SEQ ID NO: 21167 - protein, 15 aa, Drosophila melanogaster
RHCKPAVDEETFQKM

SEQ ID NO: 21168 - protein, 16 aa, Drosophila melanogaster
RMVESSEAFQEELKRH

SEQ ID NO: 21169 - protein, 16 aa, Drosophila melanogaster
RMVESSEAFQEELKRH

SEQ ID NO: 21170 - protein, 16 aa, Drosophila melanogaster
RMVESSEAFQEELKRH

SEQ ID NO: 21171 - protein, 15 aa, Drosophila melanogaster
RHCKPAVDEETFQKM

SEQ ID NO: 21172 - protein, 16 aa, Drosophila melanogaster
RMVESSEAFQEELKRH

SEQ ID NO: 21173 - protein, 15 aa, Drosophila melanogaster
RHCKPAVDEETFQKM

SEQ ID NO: 21174 - protein, 15 aa, Drosophila melanogaster
RHCKPAVDEETFQKM

SEQ ID NO: 21175 - protein, 16 aa, Drosophila melanogaster
RMVESSEAFQEELKRH

SEQ ID NO: 21176 - protein, 16 aa, Drosophila melanogaster
RMVESSEAFQEELKRH

SEQ ID NO: 21177 - protein, 15 aa, Drosophila melanogaster
RHCKPAVDEETFQKM

SEQ ID NO: 21178 - protein, 25 aa, Drosophila melanogaster
KLLPEDEKTEFIDEYEAEKLEYEKS

SEQ ID NO: 21179 - protein, 27 aa, Drosophila melanogaster
RNKDQTPIFTHSNYGNPAFTPQKVTKS

SEQ ID NO: 21180 - protein, 15 aa, Drosophila melanogaster
KVKTDVDMHETPSRG

SEQ ID NO: 21181 - protein, 27 aa, Drosophila melanogaster
RNKDQTPIFTHSNYGNPAFTPQKVTKS

SEQ ID NO: 21182 - protein, 8 aa, Drosophila melanogaster
RMQVLKRQ

SEQ ID NO: 21183 - protein, 28 aa, Drosophila melanogaster
RRIDIQPAEDEDDQDEGYTTKHLAYARY

SEQ ID NO: 21184 - protein, 28 aa, Drosophila melanogaster
RRIDIQPAEDEDDQDEGYTTKHLAYARY

SEQ ID NO: 21185 - protein, 28 aa, Drosophila melanogaster
RRIDIQPAEDEDDQDEGYTTKHLAYARY

SEQ ID NO: 21186 - protein, 18 aa, Drosophila melanogaster
KSKLTSEEFAQPNAEVKK

SEQ ID NO: 21187 - protein, 12 aa, Drosophila melanogaster
RKRTELASSSRK

SEQ ID NO: 21188 - protein, 10 aa, Drosophila melanogaster
RTTAKDEARV

SEQ ID NO: 21189 - protein, 12 aa, Drosophila melanogaster
RQKAWDIDTNRL

SEQ ID NO: 21190 - protein, 12 aa, Drosophila melanogaster
RQKAWDIDTNRL

SEQ ID NO: 21191 - protein, 25 aa, Drosophila melanogaster
KKDGSPNIDFFQSPETLQGFESIRQ

SEQ ID NO: 21192 - protein, 25 aa, Drosophila melanogaster
KKDGSPNIDFFQSPETLQGFESIRQ

SEQ ID NO: 21193 - protein, 25 aa, Drosophila melanogaster
KKDGSPNIDFFQSPETLQGFESIRQ

SEQ ID NO: 21194 - protein, 25 aa, Drosophila melanogaster
KKDGSPNIDFFQSPETLQGFESIRQ

SEQ ID NO: 21195 - protein, 25 aa, Drosophila melanogaster
KKDGSPNIDFFQSPETLQGFESIRQ

SEQ ID NO: 21196 - protein, 15 aa, Drosophila melanogaster
KPLGKDGGLELGDKS

SEQ ID NO: 21197 - protein, 12 aa, Drosophila melanogaster
KAKHLAALEERK

SEQ ID NO: 21198 - protein, 12 aa, Drosophila melanogaster
KAKHLAALEERK

SEQ ID NO: 21199 - protein, 12 aa, Drosophila melanogaster
KAKHLAALEERK

SEQ ID NO: 21200 - protein, 12 aa, Drosophila melanogaster
KAKHLAALEERK

SEQ ID NO: 21201 - protein, 12 aa, Drosophila melanogaster
KAKHLAALEERK

SEQ ID NO: 21202 - protein, 12 aa, Drosophila melanogaster
KAKHLAALEERK

SEQ ID NO: 21203 - protein, 12 aa, Drosophila melanogaster
KAKHLAALEERK

SEQ ID NO: 21204 - protein, 12 aa, Drosophila melanogaster
KAKHLAALEERK

SEQ ID NO: 21205 - protein, 12 aa, Drosophila melanogaster
KNVEKASAGGKF

SEQ ID NO: 21206 - protein, 16 aa, Drosophila melanogaster
RMSIDDIMSFGDEKKK

SEQ ID NO: 21207 - protein, 13 aa, Drosophila melanogaster
RAMPEFFNSKNKS

SEQ ID NO: 21208 - protein, 12 aa, Drosophila melanogaster
KAKHLAALEERK

SEQ ID NO: 21209 - protein, 12 aa, Drosophila melanogaster
KAKHLAALEERK

SEQ ID NO: 21210 - protein, 12 aa, Drosophila melanogaster
KAKHLAALEERK

SEQ ID NO: 21211 - protein, 12 aa, Drosophila melanogaster
KAKHLAALEERK

SEQ ID NO: 21212 - protein, 12 aa, Drosophila melanogaster
KAKHLAALEERK

SEQ ID NO: 21213 - protein, 12 aa, Drosophila melanogaster
KAKHLAALEERK

SEQ ID NO: 21214 - protein, 18 aa, Drosophila melanogaster
KDGGLELGDKSGLTGIKT

SEQ ID NO: 21215 - protein, 22 aa, Drosophila melanogaster
KEITALAPSTMKIKIIAPPERK

SEQ ID NO: 21216 - protein, 22 aa, Drosophila melanogaster
KEITALAPSTMKIKIIAPPERK

SEQ ID NO: 21217 - protein, 11 aa, Drosophila melanogaster
KIKIIAPPERK

SEQ ID NO: 21218 - protein, 11 aa, Drosophila melanogaster
KIKIIAPPERK

SEQ ID NO: 21219 - protein, 11 aa, Drosophila melanogaster
KIKIIAPPERK

SEQ ID NO: 21220 - protein, 11 aa, Drosophila melanogaster
KIKIIAPPERK

SEQ ID NO: 21221 - protein, 11 aa, Drosophila melanogaster
KIKIIAPPERK

SEQ ID NO: 21222 - protein, 37 aa, Drosophila melanogaster; identical to SEQ ID NO: 19148

SEQ ID NO: 21223 - protein, 37 aa, Drosophila melanogaster; identical to SEQ ID NO: 19148

SEQ ID NO: 21224 - protein, 37 aa, Drosophila melanogaster; identical to SEQ ID NO: 19148

SEQ ID NO: 21225 - protein, 37 aa, Drosophila melanogaster; identical to SEQ ID NO: 19148

SEQ ID NO: 21226 - protein, 37 aa, Drosophila melanogaster; identical to SEQ ID NO: 19148

SEQ ID NO: 21227 - protein, 37 aa, Drosophila melanogaster; identical to SEQ ID NO: 19148

SEQ ID NO: 21228 - protein, 37 aa, Drosophila melanogaster; identical to SEQ ID NO: 19148

SEQ ID NO: 21229 - protein, 37 aa, Drosophila melanogaster; identical to SEQ ID NO: 19148

SEQ ID NO: 21230 - protein, 37 aa, Drosophila melanogaster; identical to SEQ ID NO: 19148

SEQ ID NO: 21231 - protein, 37 aa, Drosophila melanogaster; identical to SEQ ID NO: 19148

SEQ ID NO: 21232 - protein, 24 aa, Drosophila melanogaster
RSNMEVQTYMKDGMIDNWDLFEKV

SEQ ID NO: 21233 - protein, 24 aa, Drosophila melanogaster
RSNMEVQTYMKDGMIDNWDLFEKV

SEQ ID NO: 21234 - protein, 24 aa, Drosophila melanogaster
RSNMEVQTYMKDGMIDNWDLFEKV

SEQ ID NO: 21235 - protein, 24 aa, Drosophila melanogaster
RSNMEVQTYMKDGMIDNWDLFEKV

SEQ ID NO: 21236 - protein, 24 aa, Drosophila melanogaster
RSNMEVQTYMKDGMIDNWDLFEKV

SEQ ID NO: 21237 - protein, 24 aa, Drosophila melanogaster
RSNMEVQTYMKDGMIDNWDLFEKV

SEQ ID NO: 21238 - protein, 24 aa, Drosophila melanogaster
RSNMEVQTYMKDGMIDNWDLFEKV

SEQ ID NO: 21239 - protein, 7 aa, Drosophila melanogaster
KFSSFFK

SEQ ID NO: 21240 - protein, 28 aa, Drosophila melanogaster
IFISNTFYPSKEPTNDGEEGAVASWELR

SEQ ID NO: 21241 - protein, 14 aa, Drosophila melanogaster
THTTQETDGFQVKR

SEQ ID NO: 21242 - protein, 28 aa, Drosophila melanogaster
IFISNTFYPSKEPTNDGEEGAVASWELR

SEQ ID NO: 21243 - protein, 32 aa, Drosophila melanogaster; identical to SEQ ID NO: 19515

SEQ ID NO: 21244 - protein, 14 aa, Drosophila melanogaster
THTTQETDGFQVKR

SEQ ID NO: 21245 - protein, 15 aa, Drosophila melanogaster
IHETVDTINQMKTNR

SEQ ID NO: 21246 - protein, 15 aa, Drosophila melanogaster
IHETVDTINQMKTNR

SEQ ID NO: 21247 - protein, 15 aa, Drosophila melanogaster
IHETVDTINQMKTNR

SEQ ID NO: 21248 - protein, 15 aa, Drosophila melanogaster
IHETVDTINQMKTNR

SEQ ID NO: 21249 - protein, 15 aa, Drosophila melanogaster
IHETVDTINQMKTNR

SEQ ID NO: 21250 - protein, 15 aa, Drosophila melanogaster
IHETVDTINQMKTNR

SEQ ID NO: 21251 - protein, 15 aa, Drosophila melanogaster
IHETVDTINQMKTNR

SEQ ID NO: 21252 - protein, 16 aa, Drosophila melanogaster
EFFLSFAKDPQMFIHR

SEQ ID NO: 21253 - protein, 15 aa, Drosophila melanogaster
IHETVDTINQMKTNR

SEQ ID NO: 21254 - protein, 15 aa, Drosophila melanogaster
IHETVDTINQMKTNR

SEQ ID NO: 21255 - protein, 15 aa, Drosophila melanogaster
IHETVDTINQMKTNR

SEQ ID NO: 21256 - protein, 16 aa, Drosophila melanogaster
EFFLSFAKDPQMFIHR

SEQ ID NO: 21257 - protein, 15 aa, Drosophila melanogaster
IHETVDTINQMKTNR

SEQ ID NO: 21258 - protein, 7 aa, Drosophila melanogaster
ILPQKVR

SEQ ID NO: 21259 - protein, 7 aa, Drosophila melanogaster
ILPQKVR

SEQ ID NO: 21260 - protein, 7 aa, Drosophila melanogaster
ILPQKVR

SEQ ID NO: 21261 - protein, 9 aa, Drosophila melanogaster
MKFAEIPQR

SEQ ID NO: 21262 - protein, 17 aa, Drosophila melanogaster
GTGAGGGGVGSGGGSKR

SEQ ID NO: 21263 - protein, 17 aa, Drosophila melanogaster
GTGAGGGGVGSGGGSKR

SEQ ID NO: 21264 - protein, 9 aa, Drosophila melanogaster
IKIVAPPER

SEQ ID NO: 21265 - protein, 9 aa, Drosophila melanogaster
IKIVAPPER

SEQ ID NO: 21266 - protein, 9 aa, Drosophila melanogaster
IKIVAPPER

SEQ ID NO: 21267 - protein, 14 aa, Drosophila melanogaster
MQKEITALAPSTMK

SEQ ID NO: 21268 - protein, 13 aa, Drosophila melanogaster
EITALAPSTMKIK

SEQ ID NO: 21269 - protein, 13 aa, Drosophila melanogaster
EITALAPSTMKIK

SEQ ID NO: 21270 - protein, 13 aa, Drosophila melanogaster
AKLESSPGSAAVR

SEQ ID NO: 21271 - protein, 13 aa, Drosophila melanogaster
AKLESSPGSAAVR

SEQ ID NO: 21272 - protein, 11 aa, Drosophila melanogaster
WVPIASASEKK

SEQ ID NO: 21273 - protein, 9 aa, Drosophila melanogaster
VMQAVDKVR

SEQ ID NO: 21274 - protein, 9 aa, Drosophila melanogaster
VMQAVDKVR

SEQ ID NO: 21275 - protein, 7 aa, Drosophila melanogaster
AKDDIKR

SEQ ID NO: 21276 - protein, 9 aa, Drosophila melanogaster
MFQLLPSKK

SEQ ID NO: 21277 - protein, 5 aa, Drosophila melanogaster
KFLEK

SEQ ID NO: 21278 - protein, 8 aa, Drosophila melanogaster
KAFPTSHR

SEQ ID NO: 21279 - protein, 8 aa, Drosophila melanogaster
KAFPTSHR

SEQ ID NO: 21280 - protein, 10 aa, Drosophila melanogaster
IQNFLNDKEK

SEQ ID NO: 21281 - protein, 14 aa, Drosophila melanogaster
YKEILENSENFNTR

SEQ ID NO: 21282 - protein, 14 aa, Drosophila melanogaster
YKEILENSENFNTR

SEQ ID NO: 21283 - protein, 14 aa, Drosophila melanogaster
YKEILENSENFNTR

SEQ ID NO: 21284 - protein, 14 aa, Drosophila melanogaster
YKEILENSENFNTR

SEQ ID NO: 21285 - protein, 14 aa, Drosophila melanogaster
YKEILENSENFNTR

SEQ ID NO: 21286 - protein, 14 aa, Drosophila melanogaster
YKEILENSENFNTR

SEQ ID NO: 21287 - protein, 10 aa, Drosophila melanogaster
IQNFLNDKEK

SEQ ID NO: 21288 - protein, 14 aa, Drosophila melanogaster
YKEILENSENFNTR

SEQ ID NO: 21289 - protein, 6 aa, Drosophila melanogaster
KGGGNR

SEQ ID NO: 21290 - protein, 10 aa, Drosophila melanogaster
KNAVEGESDR

SEQ ID NO: 21291 - protein, 11 aa, Drosophila melanogaster
RKNAVEGESDR

SEQ ID NO: 21292 - protein, 10 aa, Drosophila melanogaster
KNAVEGESDR

SEQ ID NO: 21293 - protein, 10 aa, Drosophila melanogaster
KNAVEGESDR

SEQ ID NO: 21294 - protein, 10 aa, Drosophila melanogaster
KNAVEGESDR

SEQ ID NO: 21295 - protein, 11 aa, Drosophila melanogaster
KNAVEGESDRK

SEQ ID NO: 21296 - protein, 11 aa, Drosophila melanogaster
RKNAVEGESDR

SEQ ID NO: 21297 - protein, 10 aa, Drosophila melanogaster
KNAVEGESDR

SEQ ID NO: 21298 - protein, 11 aa, Drosophila melanogaster
RKNAVEGESDR

SEQ ID NO: 21299 - protein, 6 aa, Drosophila melanogaster
KGGGNR

SEQ ID NO: 21300 - protein, 11 aa, Drosophila melanogaster
KNAVEGESDRK

SEQ ID NO: 21301 - protein, 10 aa, Drosophila melanogaster
KNAVEGESDR

SEQ ID NO: 21302 - protein, 6 aa, Drosophila melanogaster
KGGGNR

SEQ ID NO: 21303 - protein, 10 aa, Drosophila melanogaster
KNAVEGESDR

SEQ ID NO: 21304 - protein, 10 aa, Drosophila melanogaster
KNAVEGESDR

SEQ ID NO: 21305 - protein, 11 aa, Drosophila melanogaster
RKNAVEGESDR

SEQ ID NO: 21306 - protein, 10 aa, Drosophila melanogaster
KNAVEGESDR

SEQ ID NO: 21307 - protein, 11 aa, Drosophila melanogaster
RKNAVEGESDR

SEQ ID NO: 21308 - protein, 6 aa, Drosophila melanogaster
KGGGNR

SEQ ID NO: 21309 - protein, 11 aa, Drosophila melanogaster
RKNAVEGESDR

SEQ ID NO: 21310 - protein, 10 aa, Drosophila melanogaster
KNAVEGESDR

SEQ ID NO: 21311 - protein, 10 aa, Drosophila melanogaster
KNAVEGESDR

SEQ ID NO: 21312 - protein, 6 aa, Drosophila melanogaster
KGGGNR

SEQ ID NO: 21313 - protein, 6 aa, Drosophila melanogaster
KGGGNR

SEQ ID NO: 21314 - protein, 16 aa, Drosophila melanogaster
KTNMPEELVSCSDCGR

SEQ ID NO: 21315 - protein, 16 aa, Drosophila melanogaster
KTNMPEELVSCSDCGR

SEQ ID NO: 21316 - protein, 6 aa, Drosophila melanogaster
KGGGNR

SEQ ID NO: 21317 - protein, 10 aa, Drosophila melanogaster
KNAVEGESDR

SEQ ID NO: 21318 - protein, 10 aa, Drosophila melanogaster
KNAVEGESDR

SEQ ID NO: 21319 - protein, 10 aa, Drosophila melanogaster
KNAVEGESDR

SEQ ID NO: 21320 - protein, 5 aa, Drosophila melanogaster
KKCSR

SEQ ID NO: 21321 - protein, 5 aa, Drosophila melanogaster
KKCSR

SEQ ID NO: 21322 - protein, 5 aa, Drosophila melanogaster
KKCSR

SEQ ID NO: 21323 - protein, 5 aa, Drosophila melanogaster
KKCSR

SEQ ID NO: 21324 - protein, 5 aa, Drosophila melanogaster
KKCSR

SEQ ID NO: 21325 - protein, 11 aa, Drosophila melanogaster
RKNAVEGESDR

SEQ ID NO: 21326 - protein, 11 aa, Drosophila melanogaster
RKNAVEGESDR

SEQ ID NO: 21327 - protein, 11 aa, Drosophila melanogaster
RKNAVEGESDR

SEQ ID NO: 21328 - protein, 11 aa, Drosophila melanogaster
RKNAVEGESDR

SEQ ID NO: 21329 - protein, 10 aa, Drosophila melanogaster
KNAVEGESDR

SEQ ID NO: 21330 - protein, 11 aa, Drosophila melanogaster
RKNAVEGESDR

SEQ ID NO: 21331 - protein, 11 aa, Drosophila melanogaster
RKNAVEGESDR

SEQ ID NO: 21332 - protein, 11 aa, Drosophila melanogaster
RKNAVEGESDR

SEQ ID NO: 21333 - protein, 11 aa, Drosophila melanogaster
RKNAVEGESDR

SEQ ID NO: 21334 - protein, 10 aa, Drosophila melanogaster
KNAVEGESDR

SEQ ID NO: 21335 - protein, 11 aa, Drosophila melanogaster
RKNAVEGESDR

SEQ ID NO: 21336 - protein, 10 aa, Drosophila melanogaster
KNAVEGESDR

SEQ ID NO: 21337 - protein, 11 aa, Drosophila melanogaster
RKNAVEGESDR

SEQ ID NO: 21338 - protein, 11 aa, Drosophila melanogaster
RKNAVEGESDR

SEQ ID NO: 21339 - protein, 11 aa, Drosophila melanogaster
RKNAVEGESDR

SEQ ID NO: 21340 - protein, 11 aa, Drosophila melanogaster
RKNAVEGESDR

SEQ ID NO: 21341 - protein, 10 aa, Drosophila melanogaster
KNAVEGESDR

SEQ ID NO: 21342 - protein, 16 aa, Drosophila melanogaster
KTNMPEELVSCSDCGR

SEQ ID NO: 21343 - protein, 10 aa, Drosophila melanogaster
KNAVEGESDR

SEQ ID NO: 21344 - protein, 10 aa, Drosophila melanogaster
KNAVEGESDR

SEQ ID NO: 21345 - protein, 10 aa, Drosophila melanogaster
KNAVEGESDR

SEQ ID NO: 21346 - protein, 10 aa, Drosophila melanogaster
KNAVEGESDR

SEQ ID NO: 21347 - protein, 16 aa, Drosophila melanogaster
KTNMPEELVSCSDCGR

SEQ ID NO: 21348 - protein, 10 aa, Drosophila melanogaster
KNAVEGESDR

SEQ ID NO: 21349 - protein, 10 aa, Drosophila melanogaster
KNAVEGESDR

SEQ ID NO: 21350 - protein, 10 aa, Drosophila melanogaster
KNAVEGESDR

SEQ ID NO: 21351 - protein, 10 aa, Drosophila melanogaster
KNAVEGESDR

SEQ ID NO: 21352 - protein, 11 aa, Drosophila melanogaster
KNAVEGESDRK

SEQ ID NO: 21353 - protein, 11 aa, Drosophila melanogaster
KNAVEGESDRK

SEQ ID NO: 21354 - protein, 11 aa, Drosophila melanogaster
TNANVEGTPKR

SEQ ID NO: 21355 - protein, 11 aa, Drosophila melanogaster
TNANVEGTPKR

SEQ ID NO: 21356 - protein, 11 aa, Drosophila melanogaster
TNANVEGTPKR

SEQ ID NO: 21357 - protein, 11 aa, Drosophila melanogaster
TNANVEGTPKR

SEQ ID NO: 21358 - protein, 12 aa, Drosophila melanogaster
RTNANVEGTPKR

SEQ ID NO: 21359 - protein, 11 aa, Drosophila melanogaster
TNANVEGTPKR

SEQ ID NO: 21360 - protein, 11 aa, Drosophila melanogaster
TNANVEGTPKR

SEQ ID NO: 21361 - protein, 11 aa, Drosophila melanogaster
TNANVEGTPKR

SEQ ID NO: 21362 - protein, 11 aa, Drosophila melanogaster
TNANVEGTPKR

SEQ ID NO: 21363 - protein, 12 aa, Drosophila melanogaster
RTNANVEGTPKR

SEQ ID NO: 21364 - protein, 12 aa, Drosophila melanogaster
RTNANVEGTPKR

SEQ ID NO: 21365 - protein, 12 aa, Drosophila melanogaster
RTNANVEGTPKR

SEQ ID NO: 21366 - protein, 12 aa, Drosophila melanogaster
RTNANVEGTPKR

SEQ ID NO: 21367 - protein, 12 aa, Drosophila melanogaster
RTNANVEGTPKR

SEQ ID NO: 21368 - protein, 12 aa, Drosophila melanogaster
RTNANVEGTPKR

SEQ ID NO: 21369 - protein, 11 aa, Drosophila melanogaster
TNANVEGTPKR

SEQ ID NO: 21370 - protein, 11 aa, Drosophila melanogaster
KNAVEGESDRK

SEQ ID NO: 21371 - protein, 12 aa, Drosophila melanogaster
RTNANVEGTPKR

SEQ ID NO: 21372 - protein, 12 aa, Drosophila melanogaster
RTNANVEGTPKR

SEQ ID NO: 21373 - protein, 11 aa, Drosophila melanogaster
TNANVEGTPKR

SEQ ID NO: 21374 - protein, 11 aa, Drosophila melanogaster
TNANVEGTPKR

SEQ ID NO: 21375 - protein, 12 aa, Drosophila melanogaster
RTNANVEGTPKR

SEQ ID NO: 21376 - protein, 12 aa, Drosophila melanogaster
RTNANVEGTPKR

SEQ ID NO: 21377 - protein, 12 aa, Drosophila melanogaster
RTNANVEGTPKR

SEQ ID NO: 21378 - protein, 12 aa, Drosophila melanogaster
RTNANVEGTPKR

SEQ ID NO: 21379 - protein, 10 aa, Drosophila melanogaster
KNAVEGESDR

SEQ ID NO: 21380 - protein, 10 aa, Drosophila melanogaster
KNAVEGESDR

SEQ ID NO: 21381 - protein, 12 aa, Drosophila melanogaster
RTNANVEGTPKR

SEQ ID NO: 21382 - protein, 10 aa, Drosophila melanogaster
KNAVEGESDR

SEQ ID NO: 21383 - protein, 12 aa, Drosophila melanogaster
RTNANVEGTPKR

SEQ ID NO: 21384 - protein, 12 aa, Drosophila melanogaster
RTNANVEGTPKR

SEQ ID NO: 21385 - protein, 11 aa, Drosophila melanogaster
KNAVEGESDRK

SEQ ID NO: 21386 - protein, 12 aa, Drosophila melanogaster
RTNANVEGTPKR

SEQ ID NO: 21387 - protein, 12 aa, Drosophila melanogaster
RTNANVEGTPKR

SEQ ID NO: 21388 - protein, 11 aa, Drosophila melanogaster
TNANVEGTPKR

SEQ ID NO: 21389 - protein, 11 aa, Drosophila melanogaster
KNAVEGESDRK

SEQ ID NO: 21390 - protein, 12 aa, Drosophila melanogaster
RTNANVEGTPKR

SEQ ID NO: 21391 - protein, 12 aa, Drosophila melanogaster
RTNANVEGTPKR

SEQ ID NO: 21392 - protein, 11 aa, Drosophila melanogaster
KNAVEGESDRK

SEQ ID NO: 21393 - protein, 12 aa, Drosophila melanogaster
RTNANVEGTPKR

SEQ ID NO: 21394 - protein, 10 aa, Drosophila melanogaster
KNAVEGESDR

SEQ ID NO: 21395 - protein, 11 aa, Drosophila melanogaster
TNANVEGTPKR

SEQ ID NO: 21396 - protein, 12 aa, Drosophila melanogaster
RTNANVEGTPKR

SEQ ID NO: 21397 - protein, 11 aa, Drosophila melanogaster
TNANVEGTPKR

SEQ ID NO: 21398 - protein, 11 aa, Drosophila melanogaster
RKNAVEGESDR

SEQ ID NO: 21399 - protein, 12 aa, Drosophila melanogaster
RTNANVEGTPKR

SEQ ID NO: 21400 - protein, 12 aa, Drosophila melanogaster
RTNANVEGTPKR

SEQ ID NO: 21401 - protein, 11 aa, Drosophila melanogaster
TNANVEGTPKR

SEQ ID NO: 21402 - protein, 11 aa, Drosophila melanogaster
TNANVEGTPKR

SEQ ID NO: 21403 - protein, 11 aa, Drosophila melanogaster
TNANVEGTPKR

SEQ ID NO: 21404 - protein, 12 aa, Drosophila melanogaster
RTNANVEGTPKR

SEQ ID NO: 21405 - protein, 12 aa, Drosophila melanogaster
RTNANVEGTPKR

SEQ ID NO: 21406 - protein, 12 aa, Drosophila melanogaster
RTNANVEGTPKR

SEQ ID NO: 21407 - protein, 12 aa, Drosophila melanogaster
RTNANVEGTPKR

SEQ ID NO: 21408 - protein, 12 aa, Drosophila melanogaster
RTNANVEGTPKR

SEQ ID NO: 21409 - protein, 12 aa, Drosophila melanogaster
RTNANVEGTPKR

SEQ ID NO: 21410 - protein, 12 aa, Drosophila melanogaster
RTNANVEGTPKR

SEQ ID NO: 21411 - protein, 12 aa, Drosophila melanogaster
RTNANVEGTPKR

SEQ ID NO: 21412 - protein, 11 aa, Drosophila melanogaster
KNAVEGESDRK

SEQ ID NO: 21413 - protein, 11 aa, Drosophila melanogaster
TNANVEGTPKR

SEQ ID NO: 21414 - protein, 10 aa, Drosophila melanogaster
KNAVEGESDR

SEQ ID NO: 21415 - protein, 11 aa, Drosophila melanogaster
RKNAVEGESDR

SEQ ID NO: 21416 - protein, 12 aa, Drosophila melanogaster
RTNANVEGTPKR

SEQ ID NO: 21417 - protein, 11 aa, Drosophila melanogaster
TNANVEGTPKR

SEQ ID NO: 21418 - protein, 12 aa, Drosophila melanogaster
RTNANVEGTPKR

SEQ ID NO: 21419 - protein, 12 aa, Drosophila melanogaster
RTNANVEGTPKR

SEQ ID NO: 21420 - protein, 11 aa, Drosophila melanogaster
RKNAVEGESDR

SEQ ID NO: 21421 - protein, 11 aa, Drosophila melanogaster
RKNAVEGESDR

SEQ ID NO: 21422 - protein, 10 aa, Drosophila melanogaster
KNAVEGESDR

SEQ ID NO: 21423 - protein, 12 aa, Drosophila melanogaster
RTNANVEGTPKR

SEQ ID NO: 21424 - protein, 12 aa, Drosophila melanogaster
RTNANVEGTPKR

SEQ ID NO: 21425 - protein, 11 aa, Drosophila melanogaster
RKNAVEGESDR

SEQ ID NO: 21426 - protein, 11 aa, Drosophila melanogaster
TNANVEGTPKR

SEQ ID NO: 21427 - protein, 12 aa, Drosophila melanogaster
RTNANVEGTPKR

SEQ ID NO: 21428 - protein, 12 aa, Drosophila melanogaster
RTNANVEGTPKR

SEQ ID NO: 21429 - protein, 12 aa, Drosophila melanogaster
RTNANVEGTPKR

SEQ ID NO: 21430 - protein, 12 aa, Drosophila melanogaster
RTNANVEGTPKR

SEQ ID NO: 21431 - protein, 12 aa, Drosophila melanogaster
RTNANVEGTPKR

SEQ ID NO: 21432 - protein, 21 aa, Drosophila melanogaster
DIAQPSPYCDFCLGDQRENKK

SEQ ID NO: 21433 - protein, 21 aa, Drosophila melanogaster
DIAQPSPYCDFCLGDQRENKK

SEQ ID NO: 21434 - protein, 12 aa, Drosophila melanogaster
RTNANVEGTPKR

SEQ ID NO: 21435 - protein, 12 aa, Drosophila melanogaster
RTNANVEGTPKR

SEQ ID NO: 21436 - protein, 12 aa, Drosophila melanogaster
RTNANVEGTPKR

SEQ ID NO: 21437 - protein, 12 aa, Drosophila melanogaster
RTNANVEGTPKR

SEQ ID NO: 21438 - protein, 11 aa, Drosophila melanogaster
TNANVEGTPKR

SEQ ID NO: 21439 - protein, 6 aa, Drosophila melanogaster
KGGGNR

SEQ ID NO: 21440 - protein, 11 aa, Drosophila melanogaster
TNANVEGTPKR

SEQ ID NO: 21441 - protein, 12 aa, Drosophila melanogaster
RTNANVEGTPKR

SEQ ID NO: 21442 - protein, 12 aa, Drosophila melanogaster
RTNANVEGTPKR

SEQ ID NO: 21443 - protein, 11 aa, Drosophila melanogaster
TNANVEGTPKR

SEQ ID NO: 21444 - protein, 12 aa, Drosophila melanogaster
RTNANVEGTPKR

SEQ ID NO: 21445 - protein, 12 aa, Drosophila melanogaster
RTNANVEGTPKR

SEQ ID NO: 21446 - protein, 12 aa, Drosophila melanogaster
RTNANVEGTPKR

SEQ ID NO: 21447 - protein, 11 aa, Drosophila melanogaster
TNANVEGTPKR

SEQ ID NO: 21448 - protein, 11 aa, Drosophila melanogaster
TNANVEGTPKR

SEQ ID NO: 21449 - protein, 8 aa, Drosophila melanogaster
GRKGGGNR

SEQ ID NO: 21450 - protein, 11 aa, Drosophila melanogaster
TNANVEGTPKR

SEQ ID NO: 21451 - protein, 6 aa, Drosophila melanogaster
KGGGNR

SEQ ID NO: 21452 - protein, 12 aa, Drosophila melanogaster
RTNANVEGTPKR

SEQ ID NO: 21453 - protein, 11 aa, Drosophila melanogaster
TNANVEGTPKR

SEQ ID NO: 21454 - protein, 12 aa, Drosophila melanogaster
RTNANVEGTPKR

SEQ ID NO: 21455 - protein, 12 aa, Drosophila melanogaster
RTNANVEGTPKR

SEQ ID NO: 21456 - protein, 12 aa, Drosophila melanogaster
RTNANVEGTPKR

SEQ ID NO: 21457 - protein, 12 aa, Drosophila melanogaster
RTNANVEGTPKR

SEQ ID NO: 21458 - protein, 11 aa, Drosophila melanogaster
TNANVEGTPKR

SEQ ID NO: 21459 - protein, 12 aa, Drosophila melanogaster
RTNANVEGTPKR

SEQ ID NO: 21460 - protein, 11 aa, Drosophila melanogaster
TNANVEGTPKR

SEQ ID NO: 21461 - protein, 6 aa, Drosophila melanogaster
KGGGNR

SEQ ID NO: 21462 - protein, 12 aa, Drosophila melanogaster
RTNANVEGTPKR

SEQ ID NO: 21463 - protein, 6 aa, Drosophila melanogaster
KGGGNR

SEQ ID NO: 21464 - protein, 12 aa, Drosophila melanogaster
RTNANVEGTPKR

SEQ ID NO: 21465 - protein, 6 aa, Drosophila melanogaster
KGGGNR

SEQ ID NO: 21466 - protein, 12 aa, Drosophila melanogaster
RTNANVEGTPKR

SEQ ID NO: 21467 - protein, 6 aa, Drosophila melanogaster
KGGGNR

SEQ ID NO: 21468 - protein, 6 aa, Drosophila melanogaster
KGGGNR

SEQ ID NO: 21469 - protein, 12 aa, Drosophila melanogaster
RTNANVEGTPKR

SEQ ID NO: 21470 - protein, 11 aa, Drosophila melanogaster
TNANVEGTPKR

SEQ ID NO: 21471 - protein, 12 aa, Drosophila melanogaster
RTNANVEGTPKR

SEQ ID NO: 21472 - protein, 11 aa, Drosophila melanogaster
TNANVEGTPKR

SEQ ID NO: 21473 - protein, 16 aa, Drosophila melanogaster
KTNMPEELVSCSDCGR

SEQ ID NO: 21474 - protein, 16 aa, Drosophila melanogaster
KTNMPEELVSCSDCGR

SEQ ID NO: 21475 - protein, 16 aa, Drosophila melanogaster
KTNMPEELVSCSDCGR

SEQ ID NO: 21476 - protein, 16 aa, Drosophila melanogaster
KTNMPEELVSCSDCGR

SEQ ID NO: 21477 - protein, 8 aa, Drosophila melanogaster
NNKAQLAR

SEQ ID NO: 21478 - protein, 8 aa, Drosophila melanogaster
NNKAQLAR

SEQ ID NO: 21479 - protein, 8 aa, Drosophila melanogaster
NNKAQLAR

SEQ ID NO: 21480 - protein, 8 aa, Drosophila melanogaster
NNKAQLAR

SEQ ID NO: 21481 - protein, 8 aa, Drosophila melanogaster
NNKAQLAR

SEQ ID NO: 21482 - protein, 8 aa, Drosophila melanogaster
NNKAQLAR

SEQ ID NO: 21483 - protein, 8 aa, Drosophila melanogaster
NNKAQLAR

SEQ ID NO: 21484 - protein, 8 aa, Drosophila melanogaster
NNKAQLAR

SEQ ID NO: 21485 - protein, 5 aa, Drosophila melanogaster
KILQR

SEQ ID NO: 21486 - protein, 5 aa, Drosophila melanogaster
KILQR

SEQ ID NO: 21487 - protein, 6 aa, Drosophila melanogaster
KEEEGK

SEQ ID NO: 21488 - protein, 7 aa, Drosophila melanogaster
KEEEGKR

SEQ ID NO: 21489 - protein, 7 aa, Drosophila melanogaster
KEEEGKR

SEQ ID NO: 21490 - protein, 15 aa, Drosophila melanogaster
IQWKYMIIDEGHRMK

SEQ ID NO: 21491 - protein, 7 aa, Drosophila melanogaster
KLIDQKK

SEQ ID NO: 21492 - protein, 5 aa, Drosophila melanogaster
IEKER

SEQ ID NO: 21493 - protein, 5 aa, Drosophila melanogaster
IEKER

SEQ ID NO: 21494 - protein, 5 aa, Drosophila melanogaster
IEKER

SEQ ID NO: 21495 - protein, 5 aa, Drosophila melanogaster
IEKER

SEQ ID NO: 21496 - protein, 5 aa, Drosophila melanogaster
KEQER

SEQ ID NO: 21497 - protein, 5 aa, Drosophila melanogaster
KEQER

SEQ ID NO: 21498 - protein, 5 aa, Drosophila melanogaster
KEQER

SEQ ID NO: 21499 - protein, 5 aa, Drosophila melanogaster
KILQR

SEQ ID NO: 21500 - protein, 5 aa, Drosophila melanogaster
KILQR

SEQ ID NO: 21501 - protein, 12 aa, Drosophila melanogaster
TLSEPFMKLPSR

SEQ ID NO: 21502 - protein, 12 aa, Drosophila melanogaster
TLSEPFMKLPSR

SEQ ID NO: 21503 - protein, 12 aa, Drosophila melanogaster
TLSEPFMKLPSR

SEQ ID NO: 21504 - protein, 11 aa, Drosophila melanogaster
VHVVEQCTGKK

SEQ ID NO: 21505 - protein, 11 aa, Drosophila melanogaster
VHVVEQCTGKK

SEQ ID NO: 21506 - protein, 11 aa, Drosophila melanogaster
VHVVEQCTGKK

SEQ ID NO: 21507 - protein, 5 aa, Drosophila melanogaster
IEKER

SEQ ID NO: 21508 - protein, 16 aa, Drosophila melanogaster
AQATGNDEDAKDLITK

SEQ ID NO: 21509 - protein, 15 aa, Drosophila melanogaster
AIDSMEEKGLQEDPR

SEQ ID NO: 21510 - protein, 5 aa, Drosophila melanogaster
IEKER

SEQ ID NO: 21511 - protein, 5 aa, Drosophila melanogaster
IEKER

SEQ ID NO: 21512 - protein, 5 aa, Drosophila melanogaster
IEKER

SEQ ID NO: 21513 - protein, 11 aa, Drosophila melanogaster
KKEDEEIHPGR

SEQ ID NO: 21514 - protein, 11 aa, Drosophila melanogaster
KKEDEEIHPGR

SEQ ID NO: 21515 - protein, 10 aa, Drosophila melanogaster
SEEEIEIFKR

SEQ ID NO: 21516 - protein, 11 aa, Drosophila melanogaster
KKEDEEIHPGR

SEQ ID NO: 21517 - protein, 11 aa, Drosophila melanogaster
KKEDEEIHPGR

SEQ ID NO: 21518 - protein, 11 aa, Drosophila melanogaster
KKEDEEIHPGR

SEQ ID NO: 21519 - protein, 11 aa, Drosophila melanogaster
KKEDEEIHPGR

SEQ ID NO: 21520 - protein, 11 aa, Drosophila melanogaster
KKEDEEIHPGR

SEQ ID NO: 21521 - protein, 10 aa, Drosophila melanogaster
SEEEIEIFKR

SEQ ID NO: 21522 - protein, 11 aa, Drosophila melanogaster
KKEDEEIHPGR

SEQ ID NO: 21523 - protein, 10 aa, Drosophila melanogaster
SEEEIEIFKR

SEQ ID NO: 21524 - protein, 11 aa, Drosophila melanogaster
KKEDEEIHPGR

SEQ ID NO: 21525 - protein, 11 aa, Drosophila melanogaster
KKEDEEIHPGR

SEQ ID NO: 21526 - protein, 10 aa, Drosophila melanogaster
SEEEIEIFKR

SEQ ID NO: 21527 - protein, 11 aa, Drosophila melanogaster
KKEDEEIHPGR

SEQ ID NO: 21528 - protein, 11 aa, Drosophila melanogaster
KKEDEEIHPGR

SEQ ID NO: 21529 - protein, 10 aa, Drosophila melanogaster
SEEEIEIFKR

SEQ ID NO: 21530 - protein, 13 aa, Drosophila melanogaster
VKTDVDMHETPSR

SEQ ID NO: 21531 - protein, 10 aa, Drosophila melanogaster
GGGSKSQHER

SEQ ID NO: 21532 - protein, 10 aa, Drosophila melanogaster
GGGSKSQHER

SEQ ID NO: 21533 - protein, 13 aa, Drosophila melanogaster
HCKPAVDEETFQK

SEQ ID NO: 21534 - protein, 13 aa, Drosophila melanogaster
HCKPAVDEETFQK

SEQ ID NO: 21535 - protein, 14 aa, Drosophila melanogaster
MVESSEAFQEELKR

SEQ ID NO: 21536 - protein, 13 aa, Drosophila melanogaster
HCKPAVDEETFQK

SEQ ID NO: 21537 - protein, 14 aa, Drosophila melanogaster
MVESSEAFQEELKR

SEQ ID NO: 21538 - protein, 14 aa, Drosophila melanogaster
MVESSEAFQEELKR

SEQ ID NO: 21539 - protein, 14 aa, Drosophila melanogaster
MVESSEAFQEELKR

SEQ ID NO: 21540 - protein, 13 aa, Drosophila melanogaster
HCKPAVDEETFQK

SEQ ID NO: 21541 - protein, 14 aa, Drosophila melanogaster
MVESSEAFQEELKR

SEQ ID NO: 21542 - protein, 13 aa, Drosophila melanogaster
HCKPAVDEETFQK

SEQ ID NO: 21543 - protein, 13 aa, Drosophila melanogaster
HCKPAVDEETFQK

SEQ ID NO: 21544 - protein, 14 aa, Drosophila melanogaster
MVESSEAFQEELKR

SEQ ID NO: 21545 - protein, 14 aa, Drosophila melanogaster
MVESSEAFQEELKR

SEQ ID NO: 21546 - protein, 13 aa, Drosophila melanogaster
HCKPAVDEETFQK

SEQ ID NO: 21547 - protein, 23 aa, Drosophila melanogaster
LLPEDEKTEFIDEYEAEKLEYEK

SEQ ID NO: 21548 - protein, 25 aa, Drosophila melanogaster
NKDQTPIFTHSNYGNPAFTPQKVTK

SEQ ID NO: 21549 - protein, 13 aa, Drosophila melanogaster
VKTDVDMHETPSR

SEQ ID NO: 21550 - protein, 25 aa, Drosophila melanogaster
NKDQTPIFTHSNYGNPAFTPQKVTK

SEQ ID NO: 21551 - protein, 6 aa, Drosophila melanogaster
MQVLKR

SEQ ID NO: 21552 - protein, 26 aa, Drosophila melanogaster
RIDIQPAEDEDDQDEGYTTKHLAYAR

SEQ ID NO: 21553 - protein, 26 aa, Drosophila melanogaster
RIDIQPAEDEDDQDEGYTTKHLAYAR

SEQ ID NO: 21554 - protein, 26 aa, Drosophila melanogaster
RIDIQPAEDEDDQDEGYTTKHLAYAR

SEQ ID NO: 21555 - protein, 16 aa, Drosophila melanogaster
SKLTSEEFAQPNAEVK

SEQ ID NO: 21556 - protein, 10 aa, Drosophila melanogaster
KRTELASSSR

SEQ ID NO: 21557 - protein, 8 aa, Drosophila melanogaster
TTAKDEAR

SEQ ID NO: 21558 - protein, 10 aa, Drosophila melanogaster
QKAWDIDTNR

SEQ ID NO: 21559 - protein, 10 aa, Drosophila melanogaster
QKAWDIDTNR

SEQ ID NO: 21560 - protein, 23 aa, Drosophila melanogaster
KDGSPNIDFFQSPETLQGFESIR

SEQ ID NO: 21561 - protein, 23 aa, Drosophila melanogaster
KDGSPNIDFFQSPETLQGFESIR

SEQ ID NO: 21562 - protein, 23 aa, Drosophila melanogaster
KDGSPNIDFFQSPETLQGFESIR

SEQ ID NO: 21563 - protein, 23 aa, Drosophila melanogaster
KDGSPNIDFFQSPETLQGFESIR

SEQ ID NO: 21564 - protein, 23 aa, Drosophila melanogaster
KDGSPNIDFFQSPETLQGFESIR

SEQ ID NO: 21565 - protein, 13 aa, Drosophila melanogaster
PLGKDGGLELGDK

SEQ ID NO: 21566 - protein, 10 aa, Drosophila melanogaster
AKHLAALEER

SEQ ID NO: 21567 - protein, 10 aa, Drosophila melanogaster
AKHLAALEER

SEQ ID NO: 21568 - protein, 10 aa, Drosophila melanogaster
AKHLAALEER

SEQ ID NO: 21569 - protein, 10 aa, Drosophila melanogaster
AKHLAALEER

SEQ ID NO: 21570 - protein, 10 aa, Drosophila melanogaster
AKHLAALEER

SEQ ID NO: 21571 - protein, 10 aa, Drosophila melanogaster
AKHLAALEER

SEQ ID NO: 21572 - protein, 10 aa, Drosophila melanogaster
AKHLAALEER

SEQ ID NO: 21573 - protein, 10 aa, Drosophila melanogaster
AKHLAALEER

SEQ ID NO: 21574 - protein, 10 aa, Drosophila melanogaster
NVEKASAGGK

SEQ ID NO: 21575 - protein, 14 aa, Drosophila melanogaster
MSIDDIMSFGDEKK

SEQ ID NO: 21576 - protein, 11 aa, Drosophila melanogaster
AMPEFFNSKNK

SEQ ID NO: 21577 - protein, 10 aa, Drosophila melanogaster
AKHLAALEER

SEQ ID NO: 21578 - protein, 10 aa, Drosophila melanogaster
AKHLAALEER

SEQ ID NO: 21579 - protein, 10 aa, Drosophila melanogaster
AKHLAALEER

SEQ ID NO: 21580 - protein, 10 aa, Drosophila melanogaster
AKHLAALEER

SEQ ID NO: 21581 - protein, 10 aa, Drosophila melanogaster
AKHLAALEER

SEQ ID NO: 21582 - protein, 10 aa, Drosophila melanogaster
AKHLAALEER

SEQ ID NO: 21583 - protein, 16 aa, Drosophila melanogaster
DGGLELGDKSGLTGIK

SEQ ID NO: 21584 - protein, 20 aa, Drosophila melanogaster
EITALAPSTMKIKIIAPPER

SEQ ID NO: 21585 - protein, 20 aa, Drosophila melanogaster
EITALAPSTMKIKIIAPPER

SEQ ID NO: 21586 - protein, 9 aa, Drosophila melanogaster
IKIIAPPER

SEQ ID NO: 21587 - protein, 9 aa, Drosophila melanogaster
IKIIAPPER

SEQ ID NO: 21588 - protein, 9 aa, Drosophila melanogaster
IKIIAPPER

SEQ ID NO: 21589 - protein, 9 aa, Drosophila melanogaster
IKIIAPPER

SEQ ID NO: 21590 - protein, 9 aa, Drosophila melanogaster
IKIIAPPER

SEQ ID NO: 21591 - protein, 35 aa, Drosophila melanogaster; identical to SEQ ID NO: 19542

SEQ ID NO: 21592 - protein, 35 aa, Drosophila melanogaster; identical to SEQ ID NO: 19542

SEQ ID NO: 21593 - protein, 35 aa, Drosophila melanogaster; identical to SEQ ID NO: 19542

SEQ ID NO: 21594 - protein, 35 aa, Drosophila melanogaster; identical to SEQ ID NO: 19542

SEQ ID NO: 21595 - protein, 35 aa, Drosophila melanogaster; identical to SEQ ID NO: 19542

SEQ ID NO: 21596 - protein, 35 aa, Drosophila melanogaster; identical to SEQ ID NO: 19542

SEQ ID NO: 21597 - protein, 35 aa, Drosophila melanogaster; identical to SEQ ID NO: 19542

SEQ ID NO: 21598 - protein, 35 aa, Drosophila melanogaster; identical to SEQ ID NO: 19542

SEQ ID NO: 21599 - protein, 35 aa, Drosophila melanogaster; identical to SEQ ID NO: 19542

SEQ ID NO: 21600 - protein, 35 aa, Drosophila melanogaster; identical to SEQ ID NO: 19542

SEQ ID NO: 21601 - protein, 22 aa, Drosophila melanogaster
SNMEVQTYMKDGMIDNWDLFEK

SEQ ID NO: 21602 - protein, 22 aa, Drosophila melanogaster
SNMEVQTYMKDGMIDNWDLFEK

SEQ ID NO: 21603 - protein, 22 aa, Drosophila melanogaster
SNMEVQTYMKDGMIDNWDLFEK

SEQ ID NO: 21604 - protein, 22 aa, Drosophila melanogaster
SNMEVQTYMKDGMIDNWDLFEK

SEQ ID NO: 21605 - protein, 22 aa, Drosophila melanogaster
SNMEVQTYMKDGMIDNWDLFEK

SEQ ID NO: 21606 - protein, 22 aa, Drosophila melanogaster
SNMEVQTYMKDGMIDNWDLFEK

SEQ ID NO: 21607 - protein, 22 aa, Drosophila melanogaster
SNMEVQTYMKDGMIDNWDLFEK

SEQ ID NO: 21608 - protein, 16 aa, Drosophila melanogaster
RLLEDGKGDPNTKIKR

SEQ ID NO: 21609 - protein, 20 aa, Drosophila melanogaster
RTHTTQETDGFQVKRPGDRN

SEQ ID NO: 21610 - protein, 34 aa, Drosophila melanogaster; identical to SEQ ID NO: 19121

SEQ ID NO: 21611 - protein, 20 aa, Drosophila melanogaster
RTHTTQETDGFQVKRPGDRN

SEQ ID NO: 21612 - protein, 16 aa, Drosophila melanogaster
RTHTTQETDGFQVKRP

SEQ ID NO: 21613 - protein, 34 aa, Drosophila melanogaster; identical to SEQ ID NO: 19121

SEQ ID NO: 21614 - protein, 18 aa, Drosophila melanogaster
REFFLSFAKDPQMFIHRW

SEQ ID NO: 21615 - protein, 18 aa, Drosophila melanogaster
REFFLSFAKDPQMFIHRW

SEQ ID NO: 21616 - protein, 18 aa, Drosophila melanogaster
REFFLSFAKDPQMFIHRW

SEQ ID NO: 21617 - protein, 18 aa, Drosophila melanogaster
REFFLSFAKDPQMFIHRW

SEQ ID NO: 21618 - protein, 18 aa, Drosophila melanogaster
REFFLSFAKDPQMFIHRW

SEQ ID NO: 21619 - protein, 18 aa, Drosophila melanogaster
REFFLSFAKDPQMFIHRW

SEQ ID NO: 21620 - protein, 18 aa, Drosophila melanogaster
REFFLSFAKDPQMFIHRW

SEQ ID NO: 21621 - protein, 17 aa, Drosophila melanogaster
KIHETVDTINQMKTNRE

SEQ ID NO: 21622 - protein, 18 aa, Drosophila melanogaster
REFFLSFAKDPQMFIHRW

SEQ ID NO: 21623 - protein, 18 aa, Drosophila melanogaster
REFFLSFAKDPQMFIHRW

SEQ ID NO: 21624 - protein, 18 aa, Drosophila melanogaster
REFFLSFAKDPQMFIHRW

SEQ ID NO: 21625 - protein, 17 aa, Drosophila melanogaster
KIHETVDTINQMKTNRE

SEQ ID NO: 21626 - protein, 18 aa, Drosophila melanogaster
REFFLSFAKDPQMFIHRW

SEQ ID NO: 21627 - protein, 17 aa, Drosophila melanogaster
KIHETVDTINQMKTNRE

SEQ ID NO: 21628 - protein, 18 aa, Drosophila melanogaster
REFFLSFAKDPQMFIHRW

SEQ ID NO: 21629 - protein, 18 aa, Drosophila melanogaster
REFFLSFAKDPQMFIHRW

SEQ ID NO: 21630 - protein, 19 aa, Drosophila melanogaster
RGTGAGGGGVGSGGGSKRS

SEQ ID NO: 21631 - protein, 17 aa, Drosophila melanogaster
KIHETVDTINQMKTNRE

SEQ ID NO: 21632 - protein, 14 aa, Drosophila melanogaster
RLDIQEALKRPMKQ

SEQ ID NO: 21633 - protein, 16 aa, Drosophila melanogaster
RMQKEITALAPSTMKI

SEQ ID NO: 21634 - protein, 16 aa, Drosophila melanogaster
RMQKEITALAPSTMKI

SEQ ID NO: 21635 - protein, 24 aa, Drosophila melanogaster
RKDLYANTVLSGGTTMYPGIADRM

SEQ ID NO: 21636 - protein, 24 aa, Drosophila melanogaster
RKDLYANTVLSGGTTMYPGIADRM

SEQ ID NO: 21637 - protein, 24 aa, Drosophila melanogaster
RKDLYANTVLSGGTTMYPGIADRM

SEQ ID NO: 21638 - protein, 24 aa, Drosophila melanogaster
RKDLYANTVLSGGTTMYPGIADRM

SEQ ID NO: 21639 - protein, 13 aa, Drosophila melanogaster
KWVPIASASEKKA

SEQ ID NO: 21640 - protein, 13 aa, Drosophila melanogaster
KWVPIASASEKKA

SEQ ID NO: 21641 - protein, 11 aa, Drosophila melanogaster
RVMQAVDKVRH

SEQ ID NO: 21642 - protein, 15 aa, Drosophila melanogaster
KAKLESSPGSAAVRR

SEQ ID NO: 21643 - protein, 15 aa, Drosophila melanogaster
KAKLESSPGSAAVRR

SEQ ID NO: 21644 - protein, 11 aa, Drosophila melanogaster
RVMQAVDKVRH

SEQ ID NO: 21645 - protein, 12 aa, Drosophila melanogaster
RTHKDALKMLKL

SEQ ID NO: 21646 - protein, 10 aa, Drosophila melanogaster
RVMSVFKERL

SEQ ID NO: 21647 - protein, 23 aa, Drosophila melanogaster
RFHPEYFELIKRPISMSQIHTKL

SEQ ID NO: 21648 - protein, 23 aa, Drosophila melanogaster
RFHPEYFELIKRPISMSQIHTKL

SEQ ID NO: 21649 - protein, 16 aa, Drosophila melanogaster
KYKEILENSENFNTRL

SEQ ID NO: 21650 - protein, 12 aa, Drosophila melanogaster
KIQNFLNDKEKY

SEQ ID NO: 21651 - protein, 12 aa, Drosophila melanogaster
KIQNFLNDKEKY

SEQ ID NO: 21652 - protein, 12 aa, Drosophila melanogaster
KIQNFLNDKEKY

SEQ ID NO: 21653 - protein, 12 aa, Drosophila melanogaster
KIQNFLNDKEKY

SEQ ID NO: 21654 - protein, 12 aa, Drosophila melanogaster
KIQNFLNDKEKY

SEQ ID NO: 21655 - protein, 12 aa, Drosophila melanogaster
KIQNFLNDKEKY

SEQ ID NO: 21656 - protein, 16 aa, Drosophila melanogaster
KYKEILENSENFNTRL

SEQ ID NO: 21657 - protein, 12 aa, Drosophila melanogaster
KIQNFLNDKEKY

SEQ ID NO: 21658 - protein, 13 aa, Drosophila melanogaster
KNAVEGESDRKRR

SEQ ID NO: 21659 - protein, 8 aa, Drosophila melanogaster
RKGGGNRR

SEQ ID NO: 21660 - protein, 8 aa, Drosophila melanogaster
RKGGGNRR

SEQ ID NO: 21661 - protein, 9 aa, Drosophila melanogaster
RKGGGNRRK

SEQ ID NO: 21662 - protein, 8 aa, Drosophila melanogaster
RKGGGNRR

SEQ ID NO: 21663 - protein, 8 aa, Drosophila melanogaster
RKGGGNRR

SEQ ID NO: 21664 - protein, 9 aa, Drosophila melanogaster
RKGGGNRRK

SEQ ID NO: 21665 - protein, 8 aa, Drosophila melanogaster
RKGGGNRR

SEQ ID NO: 21666 - protein, 9 aa, Drosophila melanogaster
RKGGGNRRK

SEQ ID NO: 21667 - protein, 8 aa, Drosophila melanogaster
RKGGGNRR

SEQ ID NO: 21668 - protein, 12 aa, Drosophila melanogaster
RKNAVEGESDRK

SEQ ID NO: 21669 - protein, 9 aa, Drosophila melanogaster
RKGGGNRRK

SEQ ID NO: 21670 - protein, 8 aa, Drosophila melanogaster
RKGGGNRR

SEQ ID NO: 21671 - protein, 12 aa, Drosophila melanogaster
RKNAVEGESDRK

SEQ ID NO: 21672 - protein, 9 aa, Drosophila melanogaster
RKGGGNRRK

SEQ ID NO: 21673 - protein, 8 aa, Drosophila melanogaster
RKGGGNRR

SEQ ID NO: 21674 - protein, 8 aa, Drosophila melanogaster
RKGGGNRR

SEQ ID NO: 21675 - protein, 9 aa, Drosophila melanogaster
RKGGGNRRK

SEQ ID NO: 21676 - protein, 8 aa, Drosophila melanogaster
RKGGGNRR

SEQ ID NO: 21677 - protein, 13 aa, Drosophila melanogaster
RKNAVEGESDRKR

SEQ ID NO: 21678 - protein, 8 aa, Drosophila melanogaster
RKGGGNRR

SEQ ID NO: 21679 - protein, 9 aa, Drosophila melanogaster
RKGGGNRRK

SEQ ID NO: 21680 - protein, 8 aa, Drosophila melanogaster
RKGGGNRR

SEQ ID NO: 21681 - protein, 11 aa, Drosophila melanogaster
KLCMEEFHKIK

SEQ ID NO: 21682 - protein, 11 aa, Drosophila melanogaster
KLCMEEFHKIK

SEQ ID NO: 21683 - protein, 8 aa, Drosophila melanogaster
RKGGGNRR

SEQ ID NO: 21684 - protein, 8 aa, Drosophila melanogaster
RKGGGNRR

SEQ ID NO: 21685 - protein, 18 aa, Drosophila melanogaster
KKTNMPEELVSCSDCGRS

SEQ ID NO: 21686 - protein, 7 aa, Drosophila melanogaster
RKKCSRP

SEQ ID NO: 21687 - protein, 7 aa, Drosophila melanogaster
RKKCSRP

SEQ ID NO: 21688 - protein, 7 aa, Drosophila melanogaster
RKKCSRP

SEQ ID NO: 21689 - protein, 13 aa, Drosophila melanogaster
RRKNAVEGESDRK

SEQ ID NO: 21690 - protein, 14 aa, Drosophila melanogaster
RRTNANVEGTPKRG

SEQ ID NO: 21691 - protein, 14 aa, Drosophila melanogaster
RRTNANVEGTPKRG

SEQ ID NO: 21692 - protein, 13 aa, Drosophila melanogaster
RTNANVEGTPKRG

SEQ ID NO: 21693 - protein, 14 aa, Drosophila melanogaster
RRTNANVEGTPKRG

SEQ ID NO: 21694 - protein, 12 aa, Drosophila melanogaster
RKNAVEGESDRK

SEQ ID NO: 21695 - protein, 13 aa, Drosophila melanogaster
RRKNAVEGESDRK

SEQ ID NO: 21696 - protein, 13 aa, Drosophila melanogaster
RRKNAVEGESDRK

SEQ ID NO: 21697 - protein, 13 aa, Drosophila melanogaster
RRKNAVEGESDRK

SEQ ID NO: 21698 - protein, 12 aa, Drosophila melanogaster
RKNAVEGESDRK

SEQ ID NO: 21699 - protein, 12 aa, Drosophila melanogaster
RKNAVEGESDRK

SEQ ID NO: 21700 - protein, 13 aa, Drosophila melanogaster
RRKNAVEGESDRK

SEQ ID NO: 21701 - protein, 13 aa, Drosophila melanogaster
RRKNAVEGESDRK

SEQ ID NO: 21702 - protein, 13 aa, Drosophila melanogaster
RRKNAVEGESDRK

SEQ ID NO: 21703 - protein, 13 aa, Drosophila melanogaster
RRKNAVEGESDRK

SEQ ID NO: 21704 - protein, 13 aa, Drosophila melanogaster
RRKNAVEGESDRK

SEQ ID NO: 21705 - protein, 13 aa, Drosophila melanogaster
RRKNAVEGESDRK

SEQ ID NO: 21706 - protein, 13 aa, Drosophila melanogaster
RRKNAVEGESDRK

SEQ ID NO: 21707 - protein, 13 aa, Drosophila melanogaster
RRKNAVEGESDRK

SEQ ID NO: 21708 - protein, 13 aa, Drosophila melanogaster
RRKNAVEGESDRK

SEQ ID NO: 21709 - protein, 6 aa, Drosophila melanogaster
KVKQRV

SEQ ID NO: 21710 - protein, 6 aa, Drosophila melanogaster
RKPKRQ

SEQ ID NO: 21711 - protein, 12 aa, Drosophila melanogaster
RKNAVEGESDRK

SEQ ID NO: 21712 - protein, 18 aa, Drosophila melanogaster
KKTNMPEELVSCSDCGRS

SEQ ID NO: 21713 - protein, 18 aa, Drosophila melanogaster
KKTNMPEELVSCSDCGRS

SEQ ID NO: 21714 - protein, 18 aa, Drosophila melanogaster
KKTNMPEELVSCSDCGRS

SEQ ID NO: 21715 - protein, 18 aa, Drosophila melanogaster
KKTNMPEELVSCSDCGRS

SEQ ID NO: 21716 - protein, 12 aa, Drosophila melanogaster
RKNAVEGESDRK

SEQ ID NO: 21717 - protein, 18 aa, Drosophila melanogaster
KKTNMPEELVSCSDCGRS

SEQ ID NO: 21718 - protein, 8 aa, Drosophila melanogaster
KKCSRPRR

SEQ ID NO: 21719 - protein, 8 aa, Drosophila melanogaster
KKCSRPRR

SEQ ID NO: 21720 - protein, 7 aa, Drosophila melanogaster
RKKCSRP

SEQ ID NO: 21721 - protein, 8 aa, Drosophila melanogaster
KKCSRPRR

SEQ ID NO: 21722 - protein, 8 aa, Drosophila melanogaster
KKCSRPRR

SEQ ID NO: 21723 - protein, 8 aa, Drosophila melanogaster
KKCSRPRR

SEQ ID NO: 21724 - protein, 7 aa, Drosophila melanogaster
RKKCSRP

SEQ ID NO: 21725 - protein, 6 aa, Drosophila melanogaster
KKCSRP

SEQ ID NO: 21726 - protein, 6 aa, Drosophila melanogaster
KKCSRP

SEQ ID NO: 21727 - protein, 6 aa, Drosophila melanogaster
KKCSRP

SEQ ID NO: 21728 - protein, 8 aa, Drosophila melanogaster
KKCSRPRR

SEQ ID NO: 21729 - protein, 8 aa, Drosophila melanogaster
KKCSRPRR

SEQ ID NO: 21730 - protein, 6 aa, Drosophila melanogaster
KKCSRP

SEQ ID NO: 21731 - protein, 6 aa, Drosophila melanogaster
KKCSRP

SEQ ID NO: 21732 - protein, 14 aa, Drosophila melanogaster
RRTNANVEGTPKRG

SEQ ID NO: 21733 - protein, 14 aa, Drosophila melanogaster
RRTNANVEGTPKRG

SEQ ID NO: 21734 - protein, 14 aa, Drosophila melanogaster
RRTNANVEGTPKRG

SEQ ID NO: 21735 - protein, 14 aa, Drosophila melanogaster
RRTNANVEGTPKRG

SEQ ID NO: 21736 - protein, 6 aa, Drosophila melanogaster
KVKQRV

SEQ ID NO: 21737 - protein, 6 aa, Drosophila melanogaster
KVKQRV

SEQ ID NO: 21738 - protein, 12 aa, Drosophila melanogaster
RKNAVEGESDRK

SEQ ID NO: 21739 - protein, 13 aa, Drosophila melanogaster
RTNANVEGTPKRG

SEQ ID NO: 21740 - protein, 13 aa, Drosophila melanogaster
RKNAVEGESDRKR

SEQ ID NO: 21741 - protein, 13 aa, Drosophila melanogaster
RKNAVEGESDRKR

SEQ ID NO: 21742 - protein, 12 aa, Drosophila melanogaster
RKNAVEGESDRK

SEQ ID NO: 21743 - protein, 12 aa, Drosophila melanogaster
RKNAVEGESDRK

SEQ ID NO: 21744 - protein, 12 aa, Drosophila melanogaster
RKNAVEGESDRK

SEQ ID NO: 21745 - protein, 12 aa, Drosophila melanogaster
RKNAVEGESDRK

SEQ ID NO: 21746 - protein, 12 aa, Drosophila melanogaster
RKNAVEGESDRK

SEQ ID NO: 21747 - protein, 12 aa, Drosophila melanogaster
RKNAVEGESDRK

SEQ ID NO: 21748 - protein, 13 aa, Drosophila melanogaster
RTNANVEGTPKRG

SEQ ID NO: 21749 - protein, 14 aa, Drosophila melanogaster
RRTNANVEGTPKRG

SEQ ID NO: 21750 - protein, 12 aa, Drosophila melanogaster
RKNAVEGESDRK

SEQ ID NO: 21751 - protein, 13 aa, Drosophila melanogaster
RTNANVEGTPKRG

SEQ ID NO: 21752 - protein, 13 aa, Drosophila melanogaster
RRKNAVEGESDRK

SEQ ID NO: 21753 - protein, 13 aa, Drosophila melanogaster
RRKNAVEGESDRK

SEQ ID NO: 21754 - protein, 14 aa, Drosophila melanogaster
RRTNANVEGTPKRG

SEQ ID NO: 21755 - protein, 12 aa, Drosophila melanogaster
RKNAVEGESDRK

SEQ ID NO: 21756 - protein, 12 aa, Drosophila melanogaster
RKNAVEGESDRK

SEQ ID NO: 21757 - protein, 13 aa, Drosophila melanogaster
RKNAVEGESDRKR

SEQ ID NO: 21758 - protein, 14 aa, Drosophila melanogaster
RRTNANVEGTPKRG

SEQ ID NO: 21759 - protein, 13 aa, Drosophila melanogaster
RRKNAVEGESDRK

SEQ ID NO: 21760 - protein, 12 aa, Drosophila melanogaster
RKNAVEGESDRK

SEQ ID NO: 21761 - protein, 14 aa, Drosophila melanogaster
RRTNANVEGTPKRG

SEQ ID NO: 21762 - protein, 12 aa, Drosophila melanogaster
RKNAVEGESDRK

SEQ ID NO: 21763 - protein, 13 aa, Drosophila melanogaster
RTNANVEGTPKRG

SEQ ID NO: 21764 - protein, 12 aa, Drosophila melanogaster
RKNAVEGESDRK

SEQ ID NO: 21765 - protein, 12 aa, Drosophila melanogaster
RKNAVEGESDRK

SEQ ID NO: 21766 - protein, 12 aa, Drosophila melanogaster
RKNAVEGESDRK

SEQ ID NO: 21767 - protein, 13 aa, Drosophila melanogaster
RTNANVEGTPKRG

SEQ ID NO: 21768 - protein, 12 aa, Drosophila melanogaster
RKNAVEGESDRK

SEQ ID NO: 21769 - protein, 13 aa, Drosophila melanogaster
RRKNAVEGESDRK

SEQ ID NO: 21770 - protein, 13 aa, Drosophila melanogaster
RRKNAVEGESDRK

SEQ ID NO: 21771 - protein, 12 aa, Drosophila melanogaster
RKNAVEGESDRK

SEQ ID NO: 21772 - protein, 13 aa, Drosophila melanogaster
RRKNAVEGESDRK

SEQ ID NO: 21773 - protein, 13 aa, Drosophila melanogaster
RRKNAVEGESDRK

SEQ ID NO: 21774 - protein, 13 aa, Drosophila melanogaster
RRKNAVEGESDRK

SEQ ID NO: 21775 - protein, 13 aa, Drosophila melanogaster
RRKNAVEGESDRK

SEQ ID NO: 21776 - protein, 12 aa, Drosophila melanogaster
RKNAVEGESDRK

SEQ ID NO: 21777 - protein, 12 aa, Drosophila melanogaster
RKNAVEGESDRK

SEQ ID NO: 21778 - protein, 13 aa, Drosophila melanogaster
RRKNAVEGESDRK

SEQ ID NO: 21779 - protein, 13 aa, Drosophila melanogaster
RRKNAVEGESDRK

SEQ ID NO: 21780 - protein, 13 aa, Drosophila melanogaster
RRKNAVEGESDRK

SEQ ID NO: 21781 - protein, 13 aa, Drosophila melanogaster
RTNANVEGTPKRG

SEQ ID NO: 21782 - protein, 13 aa, Drosophila melanogaster
RRKNAVEGESDRK

SEQ ID NO: 21783 - protein, 14 aa, Drosophila melanogaster
RRTNANVEGTPKRG

SEQ ID NO: 21784 - protein, 13 aa, Drosophila melanogaster
RTNANVEGTPKRG

SEQ ID NO: 21785 - protein, 13 aa, Drosophila melanogaster
RRKNAVEGESDRK

SEQ ID NO: 21786 - protein, 12 aa, Drosophila melanogaster
RKNAVEGESDRK

SEQ ID NO: 21787 - protein, 13 aa, Drosophila melanogaster
RRKNAVEGESDRK

SEQ ID NO: 21788 - protein, 12 aa, Drosophila melanogaster
RKNAVEGESDRK

SEQ ID NO: 21789 - protein, 14 aa, Drosophila melanogaster
RRTNANVEGTPKRG

SEQ ID NO: 21790 - protein, 13 aa, Drosophila melanogaster
RTNANVEGTPKRG

SEQ ID NO: 21791 - protein, 13 aa, Drosophila melanogaster
RTNANVEGTPKRG

SEQ ID NO: 21792 - protein, 13 aa, Drosophila melanogaster
RRKNAVEGESDRK

SEQ ID NO: 21793 - protein, 12 aa, Drosophila melanogaster
RKNAVEGESDRK

SEQ ID NO: 21794 - protein, 14 aa, Drosophila melanogaster
RRTNANVEGTPKRG

SEQ ID NO: 21795 - protein, 13 aa, Drosophila melanogaster
RRKNAVEGESDRK

SEQ ID NO: 21796 - protein, 12 aa, Drosophila melanogaster
RKNAVEGESDRK

SEQ ID NO: 21797 - protein, 13 aa, Drosophila melanogaster
RKNAVEGESDRKR

SEQ ID NO: 21798 - protein, 13 aa, Drosophila melanogaster
RRKNAVEGESDRK

SEQ ID NO: 21799 - protein, 13 aa, Drosophila melanogaster
RRKNAVEGESDRK

SEQ ID NO: 21800 - protein, 12 aa, Drosophila melanogaster
RKNAVEGESDRK

SEQ ID NO: 21801 - protein, 14 aa, Drosophila melanogaster
RRTNANVEGTPKRG

SEQ ID NO: 21802 - protein, 14 aa, Drosophila melanogaster
RRTNANVEGTPKRG

SEQ ID NO: 21803 - protein, 8 aa, Drosophila melanogaster
RKGGGNRR

SEQ ID NO: 21804 - protein, 8 aa, Drosophila melanogaster
RKGGGNRR

SEQ ID NO: 21805 - protein, 8 aa, Drosophila melanogaster
RKGGGNRR

SEQ ID NO: 21806 - protein, 8 aa, Drosophila melanogaster
RKGGGNRR

SEQ ID NO: 21807 - protein, 8 aa, Drosophila melanogaster
RKGGGNRR

SEQ ID NO: 21808 - protein, 13 aa, Drosophila melanogaster
RTNANVEGTPKRG

SEQ ID NO: 21809 - protein, 8 aa, Drosophila melanogaster
RKGGGNRR

SEQ ID NO: 21810 - protein, 8 aa, Drosophila melanogaster
RKGGGNRR

SEQ ID NO: 21811 - protein, 8 aa, Drosophila melanogaster
RKGGGNRR

SEQ ID NO: 21812 - protein, 8 aa, Drosophila melanogaster
RKGGGNRR

SEQ ID NO: 21813 - protein, 8 aa, Drosophila melanogaster
RKGGGNRR

SEQ ID NO: 21814 - protein, 9 aa, Drosophila melanogaster
RKGGGNRRK

SEQ ID NO: 21815 - protein, 8 aa, Drosophila melanogaster
RKGGGNRR

SEQ ID NO: 21816 - protein, 8 aa, Drosophila melanogaster
RKGGGNRR

SEQ ID NO: 21817 - protein, 8 aa, Drosophila melanogaster
RKGGGNRR

SEQ ID NO: 21818 - protein, 15 aa, Drosophila melanogaster
RTNANVEGTPKRGRK

SEQ ID NO: 21819 - protein, 8 aa, Drosophila melanogaster
RKGGGNRR

SEQ ID NO: 21820 - protein, 13 aa, Drosophila melanogaster
RTNANVEGTPKRG

SEQ ID NO: 21821 - protein, 9 aa, Drosophila melanogaster
RKGGGNRRK

SEQ ID NO: 21822 - protein, 8 aa, Drosophila melanogaster
RKGGGNRR

SEQ ID NO: 21823 - protein, 8 aa, Drosophila melanogaster
RKGGGNRR

SEQ ID NO: 21824 - protein, 8 aa, Drosophila melanogaster
RKGGGNRR

SEQ ID NO: 21825 - protein, 8 aa, Drosophila melanogaster
RKGGGNRR

SEQ ID NO: 21826 - protein, 9 aa, Drosophila melanogaster
RKGGGNRRK

SEQ ID NO: 21827 - protein, 8 aa, Drosophila melanogaster
RKGGGNRR

SEQ ID NO: 21828 - protein, 8 aa, Drosophila melanogaster
RKGGGNRR

SEQ ID NO: 21829 - protein, 9 aa, Drosophila melanogaster
RKGGGNRRK

SEQ ID NO: 21830 - protein, 14 aa, Drosophila melanogaster
RRTNANVEGTPKRG

SEQ ID NO: 21831 - protein, 8 aa, Drosophila melanogaster
RKGGGNRR

SEQ ID NO: 21832 - protein, 14 aa, Drosophila melanogaster
RRTNANVEGTPKRG

SEQ ID NO: 21833 - protein, 9 aa, Drosophila melanogaster
RKGGGNRRK

SEQ ID NO: 21834 - protein, 14 aa, Drosophila melanogaster
RRTNANVEGTPKRG

SEQ ID NO: 21835 - protein, 8 aa, Drosophila melanogaster
RKGGGNRR

SEQ ID NO: 21836 - protein, 14 aa, Drosophila melanogaster
RRTNANVEGTPKRG

SEQ ID NO: 21837 - protein, 13 aa, Drosophila melanogaster
RTNANVEGTPKRG

SEQ ID NO: 21838 - protein, 8 aa, Drosophila melanogaster
RKGGGNRR

SEQ ID NO: 21839 - protein, 18 aa, Drosophila melanogaster
KKTNMPEELVSCSDCGRS

SEQ ID NO: 21840 - protein, 18 aa, Drosophila melanogaster
KKTNMPEELVSCSDCGRS

SEQ ID NO: 21841 - protein, 18 aa, Drosophila melanogaster
KKTNMPEELVSCSDCGRS

SEQ ID NO: 21842 - protein, 21 aa, Drosophila melanogaster
RSGHPSCLQFTANMIISVKRY

SEQ ID NO: 21843 - protein, 21 aa, Drosophila melanogaster
RSGHPSCLQFTANMIISVKRY

SEQ ID NO: 21844 - protein, 21 aa, Drosophila melanogaster
RSGHPSCLQFTANMIISVKRY

SEQ ID NO: 21845 - protein, 21 aa, Drosophila melanogaster
RSGHPSCLQFTANMIISVKRY

SEQ ID NO: 21846 - protein, 16 aa, Drosophila melanogaster
RMNKAVMNHHANAERE

SEQ ID NO: 21847 - protein, 16 aa, Drosophila melanogaster
RMNKAVMNHHANAERE

SEQ ID NO: 21848 - protein, 16 aa, Drosophila melanogaster
RMNKAVMNHHANAERE

SEQ ID NO: 21849 - protein, 16 aa, Drosophila melanogaster
RMNKAVMNHHANAERE

SEQ ID NO: 21850 - protein, 16 aa, Drosophila melanogaster
RMNKAVMNHHANAERE

SEQ ID NO: 21851 - protein, 16 aa, Drosophila melanogaster
RMNKAVMNHHANAERE

SEQ ID NO: 21852 - protein, 16 aa, Drosophila melanogaster
RMNKAVMNHHANAERE

SEQ ID NO: 21853 - protein, 16 aa, Drosophila melanogaster
RMNKAVMNHHANAERE

SEQ ID NO: 21854 - protein, 16 aa, Drosophila melanogaster
KVEYIIKCDMSALQRV

SEQ ID NO: 21855 - protein, 16 aa, Drosophila melanogaster
KVEYIIKCDMSALQRV

SEQ ID NO: 21856 - protein, 11 aa, Drosophila melanogaster
KQHKDDQMKKK

SEQ ID NO: 21857 - protein, 11 aa, Drosophila melanogaster
KQHKDDQMKKK

SEQ ID NO: 21858 - protein, 10 aa, Drosophila melanogaster
KQHKDDQMKK

SEQ ID NO: 21859 - protein, 24 aa, Drosophila melanogaster
KLNMDEKVIQAGMFDQKSTGSERQ

SEQ ID NO: 21860 - protein, 7 aa, Drosophila melanogaster
RIEKERM

SEQ ID NO: 21861 - protein, 16 aa, Drosophila melanogaster
RMNKAVMNHHANAERE

SEQ ID NO: 21862 - protein, 16 aa, Drosophila melanogaster
RMNKAVMNHHANAERE

SEQ ID NO: 21863 - protein, 16 aa, Drosophila melanogaster
RMNKAVMNHHANAERE

SEQ ID NO: 21864 - protein, 16 aa, Drosophila melanogaster
RMNKAVMNHHANAERE

SEQ ID NO: 21865 - protein, 16 aa, Drosophila melanogaster
RMNKAVMNHHANAERE

SEQ ID NO: 21866 - protein, 16 aa, Drosophila melanogaster
RMNKAVMNHHANAERE

SEQ ID NO: 21867 - protein, 16 aa, Drosophila melanogaster
RMNKAVMNHHANAERE

SEQ ID NO: 21868 - protein, 14 aa, Drosophila melanogaster
RTLSEPFMKLPSRQ

SEQ ID NO: 21869 - protein, 14 aa, Drosophila melanogaster
RTLSEPFMKLPSRQ

SEQ ID NO: 21870 - protein, 7 aa, Drosophila melanogaster
KKILQRI

SEQ ID NO: 21871 - protein, 7 aa, Drosophila melanogaster
KKILQRI

SEQ ID NO: 21872 - protein, 7 aa, Drosophila melanogaster
KKILQRI

SEQ ID NO: 21873 - protein, 16 aa, Drosophila melanogaster
KLTGDDAPMLKHLHRW

SEQ ID NO: 21874 - protein, 16 aa, Drosophila melanogaster
KLTGDDAPMLKHLHRW

SEQ ID NO: 21875 - protein, 16 aa, Drosophila melanogaster
KLTGDDAPMLKHLHRW

SEQ ID NO: 21876 - protein, 10 aa, Drosophila melanogaster
REQKKEQERI

SEQ ID NO: 21877 - protein, 11 aa, Drosophila melanogaster
KAKVEDDEYRT

SEQ ID NO: 21878 - protein, 19 aa, Drosophila melanogaster
RATSKHQHLNGNQVNLLRT

SEQ ID NO: 21879 - protein, 10 aa, Drosophila melanogaster
REQKKEQERI

SEQ ID NO: 21880 - protein, 10 aa, Drosophila melanogaster
REQKKEQERI

SEQ ID NO: 21881 - protein, 10 aa, Drosophila melanogaster
REQKKEQERI

SEQ ID NO: 21882 - protein, 12 aa, Drosophila melanogaster
RSEEEIEIFKRM

SEQ ID NO: 21883 - protein, 12 aa, Drosophila melanogaster
RSEEEIEIFKRM

SEQ ID NO: 21884 - protein, 13 aa, Drosophila melanogaster
RKKEDEEIHPGRE

SEQ ID NO: 21885 - protein, 12 aa, Drosophila melanogaster
RSEEEIEIFKRM

SEQ ID NO: 21886 - protein, 12 aa, Drosophila melanogaster
RSEEEIEIFKRM

SEQ ID NO: 21887 - protein, 12 aa, Drosophila melanogaster
RSEEEIEIFKRM

SEQ ID NO: 21888 - protein, 12 aa, Drosophila melanogaster
RSEEEIEIFKRM

SEQ ID NO: 21889 - protein, 12 aa, Drosophila melanogaster
RSEEEIEIFKRM

SEQ ID NO: 21890 - protein, 13 aa, Drosophila melanogaster
RKKEDEEIHPGRE

SEQ ID NO: 21891 - protein, 12 aa, Drosophila melanogaster
RSEEEIEIFKRM

SEQ ID NO: 21892 - protein, 13 aa, Drosophila melanogaster
RKKEDEEIHPGRE

SEQ ID NO: 21893 - protein, 12 aa, Drosophila melanogaster
RSEEEIEIFKRM

SEQ ID NO: 21894 - protein, 12 aa, Drosophila melanogaster
RSEEEIEIFKRM

SEQ ID NO: 21895 - protein, 13 aa, Drosophila melanogaster
RKKEDEEIHPGRE

SEQ ID NO: 21896 - protein, 12 aa, Drosophila melanogaster
RSEEEIEIFKRM

SEQ ID NO: 21897 - protein, 12 aa, Drosophila melanogaster
RSEEEIEIFKRM

SEQ ID NO: 21898 - protein, 13 aa, Drosophila melanogaster
RKKEDEEIHPGRE

SEQ ID NO: 21899 - protein, 28 aa, Drosophila melanogaster
RRIDIQPAEDEDDQDEGYTTKHLAYARY

SEQ ID NO: 21900 - protein, 15 aa, Drosophila melanogaster
KVKTDVDMHETPSRG

SEQ ID NO: 21901 - protein, 15 aa, Drosophila melanogaster
KVKTDVDMHETPSRG

SEQ ID NO: 21902 - protein, 16 aa, Drosophila melanogaster
RMVESSEAFQEELKRH

SEQ ID NO: 21903 - protein, 16 aa, Drosophila melanogaster
RMVESSEAFQEELKRH

SEQ ID NO: 21904 - protein, 15 aa, Drosophila melanogaster
RHCKPAVDEETFQKM

SEQ ID NO: 21905 - protein, 16 aa, Drosophila melanogaster
RMVESSEAFQEELKRH

SEQ ID NO: 21906 - protein, 19 aa, Drosophila melanogaster
RHCKPAVDEETFQKMVLRM

SEQ ID NO: 21907 - protein, 15 aa, Drosophila melanogaster
RHCKPAVDEETFQKM

SEQ ID NO: 21908 - protein, 15 aa, Drosophila melanogaster
RHCKPAVDEETFQKM

SEQ ID NO: 21909 - protein, 16 aa, Drosophila melanogaster
RMVESSEAFQEELKRH

SEQ ID NO: 21910 - protein, 15 aa, Drosophila melanogaster
RHCKPAVDEETFQKM

SEQ ID NO: 21911 - protein, 16 aa, Drosophila melanogaster
RMVESSEAFQEELKRH

SEQ ID NO: 21912 - protein, 16 aa, Drosophila melanogaster
RMVESSEAFQEELKRH

SEQ ID NO: 21913 - protein, 15 aa, Drosophila melanogaster
RHCKPAVDEETFQKM

SEQ ID NO: 21914 - protein, 19 aa, Drosophila melanogaster
RHCKPAVDEETFQKMVLRM

SEQ ID NO: 21915 - protein, 16 aa, Drosophila melanogaster
RMVESSEAFQEELKRH

SEQ ID NO: 21916 - protein, 20 aa, Drosophila melanogaster
KSLKAYHQTPAYQAYMSAKS

SEQ ID NO: 21917 - protein, 13 aa, Drosophila melanogaster
KSSSSKNQNESRL

SEQ ID NO: 21918 - protein, 19 aa, Drosophila melanogaster
KAYHQTPAYQAYMSAKSKV

SEQ ID NO: 21919 - protein, 12 aa, Drosophila melanogaster
RGGGSKSQHERR

SEQ ID NO: 21920 - protein, 12 aa, Drosophila melanogaster
RGGGSKSQHERR

SEQ ID NO: 21921 - protein, 12 aa, Drosophila melanogaster
RGGGSKSQHERR

SEQ ID NO: 21922 - protein, 12 aa, Drosophila melanogaster
RGGGSKSQHERR

SEQ ID NO: 21923 - protein, 12 aa, Drosophila melanogaster
RGGGSKSQHERR

SEQ ID NO: 21924 - protein, 20 aa, Drosophila melanogaster
RRLVSGGSSSSGAHAEGKKS

SEQ ID NO: 21925 - protein, 7 aa, Drosophila melanogaster
RKPEIKT

SEQ ID NO: 21926 - protein, 26 aa, Drosophila melanogaster
RQQQQLRPGPAGKQAASAGGSATVKA

SEQ ID NO: 21927 - protein, 12 aa, Drosophila melanogaster
RQKAWDIDTNRL

SEQ ID NO: 21928 - protein, 12 aa, Drosophila melanogaster
RQKAWDIDTNRL

SEQ ID NO: 21929 - protein, 14 aa, Drosophila melanogaster
KLGKNSADPPATRI

SEQ ID NO: 21930 - protein, 14 aa, Drosophila melanogaster
KLGKNSADPPATRI

SEQ ID NO: 21931 - protein, 14 aa, Drosophila melanogaster
KLGKNSADPPATRI

SEQ ID NO: 21932 - protein, 14 aa, Drosophila melanogaster
KLGKNSADPPATRI

SEQ ID NO: 21933 - protein, 14 aa, Drosophila melanogaster
KLGKNSADPPATRI

SEQ ID NO: 21934 - protein, 10 aa, Drosophila melanogaster
KTLLDLDKKP

SEQ ID NO: 21935 - protein, 12 aa, Drosophila melanogaster
KAKHLAALEERK

SEQ ID NO: 21936 - protein, 12 aa, Drosophila melanogaster
KAKHLAALEERK

SEQ ID NO: 21937 - protein, 25 aa, Drosophila melanogaster
KAAMEEFAAIKDEVPATIMDNHLKN

SEQ ID NO: 21938 - protein, 25 aa, Drosophila melanogaster
KAAMEEFAAIKDEVPATIMDNHLKN

SEQ ID NO: 21939 - protein, 25 aa, Drosophila melanogaster
KAAMEEFAAIKDEVPATIMDNHLKN

SEQ ID NO: 21940 - protein, 25 aa, Drosophila melanogaster
KAAMEEFAAIKDEVPATIMDNHLKN

SEQ ID NO: 21941 - protein, 25 aa, Drosophila melanogaster
KAAMEEFAAIKDEVPATIMDNHLKN

SEQ ID NO: 21942 - protein, 25 aa, Drosophila melanogaster
KAAMEEFAAIKDEVPATIMDNHLKN

SEQ ID NO: 21943 - protein, 25 aa, Drosophila melanogaster
KAAMEEFAAIKDEVPATIMDNHLKN

SEQ ID NO: 21944 - protein, 25 aa, Drosophila melanogaster
KKDGSPNIDFFQSPETLQGFESIRQ

SEQ ID NO: 21945 - protein, 13 aa, Drosophila melanogaster
KSKTPEIYMAYRN

SEQ ID NO: 21946 - protein, 32 aa, Drosophila melanogaster; identical to SEQ ID NO: 19980

SEQ ID NO: 21947 - protein, 32 aa, Drosophila melanogaster; identical to SEQ ID NO: 19980

SEQ ID NO: 21948 - protein, 32 aa, Drosophila melanogaster; identical to SEQ ID NO: 19980

SEQ ID NO: 21949 - protein, 32 aa, Drosophila melanogaster; identical to SEQ ID NO: 19980

SEQ ID NO: 21950 - protein, 32 aa, Drosophila melanogaster; identical to SEQ ID NO: 19980

SEQ ID NO: 21951 - protein, 32 aa, Drosophila melanogaster; identical to SEQ ID NO: 19980

SEQ ID NO: 21952 - protein, 14 aa, Drosophila melanogaster
KTLLDLDKKPLGKD

SEQ ID NO: 21953 - protein, 24 aa, Drosophila melanogaster
RKDLYANTVLSGGTTMYPGIADRM

SEQ ID NO: 21954 - protein, 24 aa, Drosophila melanogaster
RKDLYANTVLSGGTTMYPGIADRM

SEQ ID NO: 21955 - protein, 24 aa, Drosophila melanogaster
RKDLYANTVLSGGTTMYPGIADRM

SEQ ID NO: 21956 - protein, 24 aa, Drosophila melanogaster
RKDLYANTVLSGGTTMYPGIADRM

SEQ ID NO: 21957 - protein, 24 aa, Drosophila melanogaster
RKDLYANTVLSGGTTMYPGIADRM

SEQ ID NO: 21958 - protein, 24 aa, Drosophila melanogaster
RKDLYANTVLSGGTTMYPGIADRM

SEQ ID NO: 21959 - protein, 24 aa, Drosophila melanogaster
RKDLYANTVLSGGTTMYPGIADRM

SEQ ID NO: 21960 - protein, 15 aa, Drosophila melanogaster
RKFYVDTNYVTVPRS

SEQ ID NO: 21961 - protein, 15 aa, Drosophila melanogaster
RKFYVDTNYVTVPRS

SEQ ID NO: 21962 - protein, 15 aa, Drosophila melanogaster
RKFYVDTNYVTVPRS

SEQ ID NO: 21963 - protein, 15 aa, Drosophila melanogaster
RKFYVDTNYVTVPRS

SEQ ID NO: 21964 - protein, 15 aa, Drosophila melanogaster
RKFYVDTNYVTVPRS

SEQ ID NO: 21965 - protein, 15 aa, Drosophila melanogaster
RKFYVDTNYVTVPRS

SEQ ID NO: 21966 - protein, 15 aa, Drosophila melanogaster
RKFYVDTNYVTVPRS

SEQ ID NO: 21967 - protein, 15 aa, Drosophila melanogaster
RKFYVDTNYVTVPRS

SEQ ID NO: 21968 - protein, 15 aa, Drosophila melanogaster
RKFYVDTNYVTVPRS

SEQ ID NO: 21969 - protein, 15 aa, Drosophila melanogaster
RKFYVDTNYVTVPRS

SEQ ID NO: 21970 - protein, 42 aa, Drosophila melanogaster
RATALVVDSGATHTSAVPVHEGYVLSQAVVKSPLGGDFLSRQ

SEQ ID NO: 21971 - protein, 42 aa, Drosophila melanogaster; identical to SEQ ID NO: 21970

SEQ ID NO: 21972 - protein, 42 aa, Drosophila melanogaster; identical to SEQ ID NO: 21970

SEQ ID NO: 21973 - protein, 42 aa, Drosophila melanogaster; identical to SEQ ID NO: 21970

SEQ ID NO: 21974 - protein, 42 aa, Drosophila melanogaster; identical to SEQ ID NO: 21970

SEQ ID NO: 21975 - protein, 42 aa, Drosophila melanogaster; identical to SEQ ID NO: 21970

SEQ ID NO: 21976 - protein, 42 aa, Drosophila melanogaster; identical to SEQ ID NO: 21970

SEQ ID NO: 21977 - protein, 14 aa, Drosophila melanogaster
LLEDGKGDPNTKIK

SEQ ID NO: 21978 - protein, 18 aa, Drosophila melanogaster
THTTQETDGFQVKRPGDR

SEQ ID NO: 21979 - protein, 32 aa, Drosophila melanogaster; identical to SEQ ID NO: 19515

SEQ ID NO: 21980 - protein, 18 aa, Drosophila melanogaster
THTTQETDGFQVKRPGDR

SEQ ID NO: 21981 - protein, 14 aa, Drosophila melanogaster
THTTQETDGFQVKR

SEQ ID NO: 21982 - protein, 32 aa, Drosophila melanogaster; identical to SEQ ID NO: 19515

SEQ ID NO: 21983 - protein, 16 aa, Drosophila melanogaster
EFFLSFAKDPQMFIHR

SEQ ID NO: 21984 - protein, 16 aa, Drosophila melanogaster
EFFLSFAKDPQMFIHR

SEQ ID NO: 21985 - protein, 16 aa, Drosophila melanogaster
EFFLSFAKDPQMFIHR

SEQ ID NO: 21986 - protein, 16 aa, Drosophila melanogaster
EFFLSFAKDPQMFIHR

SEQ ID NO: 21987 - protein, 16 aa, Drosophila melanogaster
EFFLSFAKDPQMFIHR

SEQ ID NO: 21988 - protein, 16 aa, Drosophila melanogaster
EFFLSFAKDPQMFIHR

SEQ ID NO: 21989 - protein, 16 aa, Drosophila melanogaster
EFFLSFAKDPQMFIHR

SEQ ID NO: 21990 - protein, 15 aa, Drosophila melanogaster
IHETVDTINQMKTNR

SEQ ID NO: 21991 - protein, 16 aa, Drosophila melanogaster
EFFLSFAKDPQMFIHR

SEQ ID NO: 21992 - protein, 16 aa, Drosophila melanogaster
EFFLSFAKDPQMFIHR

SEQ ID NO: 21993 - protein, 16 aa, Drosophila melanogaster
EFFLSFAKDPQMFIHR

SEQ ID NO: 21994 - protein, 15 aa, Drosophila melanogaster
IHETVDTINQMKTNR

SEQ ID NO: 21995 - protein, 16 aa, Drosophila melanogaster
EFFLSFAKDPQMFIHR

SEQ ID NO: 21996 - protein, 15 aa, Drosophila melanogaster
IHETVDTINQMKTNR

SEQ ID NO: 21997 - protein, 16 aa, Drosophila melanogaster
EFFLSFAKDPQMFIHR

SEQ ID NO: 21998 - protein, 16 aa, Drosophila melanogaster
EFFLSFAKDPQMFIHR

SEQ ID NO: 21999 - protein, 17 aa, Drosophila melanogaster
GTGAGGGGVGSGGGSKR

SEQ ID NO: 22000 - protein, 15 aa, Drosophila melanogaster
IHETVDTINQMKTNR

SEQ ID NO: 22001 - protein, 12 aa, Drosophila melanogaster
LDIQEALKRPMK

SEQ ID NO: 22002 - protein, 14 aa, Drosophila melanogaster
MQKEITALAPSTMK

SEQ ID NO: 22003 - protein, 14 aa, Drosophila melanogaster
MQKEITALAPSTMK

SEQ ID NO: 22004 - protein, 22 aa, Drosophila melanogaster
KDLYANTVLSGGTTMYPGIADR

SEQ ID NO: 22005 - protein, 22 aa, Drosophila melanogaster
KDLYANTVLSGGTTMYPGIADR

SEQ ID NO: 22006 - protein, 22 aa, Drosophila melanogaster
KDLYANTVLSGGTTMYPGIADR

SEQ ID NO: 22007 - protein, 22 aa, Drosophila melanogaster
KDLYANTVLSGGTTMYPGIADR

SEQ ID NO: 22008 - protein, 11 aa, Drosophila melanogaster
WVPIASASEKK

SEQ ID NO: 22009 - protein, 11 aa, Drosophila melanogaster
WVPIASASEKK

SEQ ID NO: 22010 - protein, 9 aa, Drosophila melanogaster
VMQAVDKVR

SEQ ID NO: 22011 - protein, 13 aa, Drosophila melanogaster
AKLESSPGSAAVR

SEQ ID NO: 22012 - protein, 13 aa, Drosophila melanogaster
AKLESSPGSAAVR

SEQ ID NO: 22013 - protein, 9 aa, Drosophila melanogaster
VMQAVDKVR

SEQ ID NO: 22014 - protein, 10 aa, Drosophila melanogaster
THKDALKMLK

SEQ ID NO: 22015 - protein, 8 aa, Drosophila melanogaster
VMSVFKER

SEQ ID NO: 22016 - protein, 21 aa, Drosophila melanogaster
FHPEYFELIKRPISMSQIHTK

SEQ ID NO: 22017 - protein, 21 aa, Drosophila melanogaster
FHPEYFELIKRPISMSQIHTK

SEQ ID NO: 22018 - protein, 14 aa, Drosophila melanogaster
YKEILENSENFNTR

SEQ ID NO: 22019 - protein, 10 aa, Drosophila melanogaster
IQNFLNDKEK

SEQ ID NO: 22020 - protein, 10 aa, Drosophila melanogaster
IQNFLNDKEK

SEQ ID NO: 22021 - protein, 10 aa, Drosophila melanogaster
IQNFLNDKEK

SEQ ID NO: 22022 - protein, 10 aa, Drosophila melanogaster
IQNFLNDKEK

SEQ ID NO: 22023 - protein, 10 aa, Drosophila melanogaster
IQNFLNDKEK

SEQ ID NO: 22024 - protein, 10 aa, Drosophila melanogaster
IQNFLNDKEK

SEQ ID NO: 22025 - protein, 14 aa, Drosophila melanogaster
YKEILENSENFNTR

SEQ ID NO: 22026 - protein, 10 aa, Drosophila melanogaster
IQNFLNDKEK

SEQ ID NO: 22027 - protein, 11 aa, Drosophila melanogaster
NAVEGESDRKR

SEQ ID NO: 22028 - protein, 6 aa, Drosophila melanogaster
KGGGNR

SEQ ID NO: 22029 - protein, 6 aa, Drosophila melanogaster
KGGGNR

SEQ ID NO: 22030 - protein, 7 aa, Drosophila melanogaster
KGGGNRR

SEQ ID NO: 22031 - protein, 6 aa, Drosophila melanogaster
KGGGNR

SEQ ID NO: 22032 - protein, 6 aa, Drosophila melanogaster
KGGGNR

SEQ ID NO: 22033 - protein, 7 aa, Drosophila melanogaster
KGGGNRR

SEQ ID NO: 22034 - protein, 6 aa, Drosophila melanogaster
KGGGNR

SEQ ID NO: 22035 - protein, 7 aa, Drosophila melanogaster
KGGGNRR

SEQ ID NO: 22036 - protein, 6 aa, Drosophila melanogaster
KGGGNR

SEQ ID NO: 22037 - protein, 10 aa, Drosophila melanogaster
KNAVEGESDR

SEQ ID NO: 22038 - protein, 7 aa, Drosophila melanogaster
KGGGNRR

SEQ ID NO: 22039 - protein, 6 aa, Drosophila melanogaster
KGGGNR

SEQ ID NO: 22040 - protein, 10 aa, Drosophila melanogaster
KNAVEGESDR

SEQ ID NO: 22041 - protein, 7 aa, Drosophila melanogaster
KGGGNRR

SEQ ID NO: 22042 - protein, 6 aa, Drosophila melanogaster
KGGGNR

SEQ ID NO: 22043 - protein, 6 aa, Drosophila melanogaster
KGGGNR

SEQ ID NO: 22044 - protein, 7 aa, Drosophila melanogaster
KGGGNRR

SEQ ID NO: 22045 - protein, 6 aa, Drosophila melanogaster
KGGGNR

SEQ ID NO: 22046 - protein, 11 aa, Drosophila melanogaster
KNAVEGESDRK

SEQ ID NO: 22047 - protein, 6 aa, Drosophila melanogaster
KGGGNR

SEQ ID NO: 22048 - protein, 7 aa, Drosophila melanogaster
KGGGNRR

SEQ ID NO: 22049 - protein, 6 aa, Drosophila melanogaster
KGGGNR

SEQ ID NO: 22050 - protein, 10 aa, Drosophila melanogaster
LCMEEFHKIK

SEQ ID NO: 22051 - protein, 10 aa, Drosophila melanogaster
LCMEEFHKIK

SEQ ID NO: 22052 - protein, 6 aa, Drosophila melanogaster
KGGGNR

SEQ ID NO: 22053 - protein, 6 aa, Drosophila melanogaster
KGGGNR

SEQ ID NO: 22054 - protein, 16 aa, Drosophila melanogaster
KTNMPEELVSCSDCGR

SEQ ID NO: 22055 - protein, 5 aa, Drosophila melanogaster
KKCSR

SEQ ID NO: 22056 - protein, 5 aa, Drosophila melanogaster
KKCSR

SEQ ID NO: 22057 - protein, 5 aa, Drosophila melanogaster
KKCSR

SEQ ID NO: 22058 - protein, 11 aa, Drosophila melanogaster
RKNAVEGESDR

SEQ ID NO: 22059 - protein, 12 aa, Drosophila melanogaster
RTNANVEGTPKR

SEQ ID NO: 22060 - protein, 12 aa, Drosophila melanogaster
RTNANVEGTPKR

SEQ ID NO: 22061 - protein, 11 aa, Drosophila melanogaster
TNANVEGTPKR

SEQ ID NO: 22062 - protein, 12 aa, Drosophila melanogaster
RTNANVEGTPKR

SEQ ID NO: 22063 - protein, 10 aa, Drosophila melanogaster
KNAVEGESDR

SEQ ID NO: 22064 - protein, 11 aa, Drosophila melanogaster
RKNAVEGESDR

SEQ ID NO: 22065 - protein, 11 aa, Drosophila melanogaster
RKNAVEGESDR

SEQ ID NO: 22066 - protein, 11 aa, Drosophila melanogaster
RKNAVEGESDR

SEQ ID NO: 22067 - protein, 10 aa, Drosophila melanogaster
KNAVEGESDR

SEQ ID NO: 22068 - protein, 10 aa, Drosophila melanogaster
KNAVEGESDR

SEQ ID NO: 22069 - protein, 11 aa, Drosophila melanogaster
RKNAVEGESDR

SEQ ID NO: 22070 - protein, 11 aa, Drosophila melanogaster
RKNAVEGESDR

SEQ ID NO: 22071 - protein, 11 aa, Drosophila melanogaster
RKNAVEGESDR

SEQ ID NO: 22072 - protein, 11 aa, Drosophila melanogaster
RKNAVEGESDR

SEQ ID NO: 22073 - protein, 11 aa, Drosophila melanogaster
RKNAVEGESDR

SEQ ID NO: 22074 - protein, 11 aa, Drosophila melanogaster
RKNAVEGESDR

SEQ ID NO: 22075 - protein, 11 aa, Drosophila melanogaster
RKNAVEGESDR

SEQ ID NO: 22076 - protein, 11 aa, Drosophila melanogaster
RKNAVEGESDR

SEQ ID NO: 22077 - protein, 11 aa, Drosophila melanogaster
RKNAVEGESDR

SEQ ID NO: 22078 - protein, 4 aa, Drosophila melanogaster
VKQR

SEQ ID NO: 22079 - protein, 4 aa, Drosophila melanogaster
KPKR

SEQ ID NO: 22080 - protein, 10 aa, Drosophila melanogaster
KNAVEGESDR

SEQ ID NO: 22081 - protein, 16 aa, Drosophila melanogaster
KTNMPEELVSCSDCGR

SEQ ID NO: 22082 - protein, 16 aa, Drosophila melanogaster
KTNMPEELVSCSDCGR

SEQ ID NO: 22083 - protein, 16 aa, Drosophila melanogaster
KTNMPEELVSCSDCGR

SEQ ID NO: 22084 - protein, 16 aa, Drosophila melanogaster
KTNMPEELVSCSDCGR

SEQ ID NO: 22085 - protein, 10 aa, Drosophila melanogaster
KNAVEGESDR

SEQ ID NO: 22086 - protein, 16 aa, Drosophila melanogaster
KTNMPEELVSCSDCGR

SEQ ID NO: 22087 - protein, 6 aa, Drosophila melanogaster
KCSRPR

SEQ ID NO: 22088 - protein, 6 aa, Drosophila melanogaster
KCSRPR

SEQ ID NO: 22089 - protein, 5 aa, Drosophila melanogaster
KKCSR

SEQ ID NO: 22090 - protein, 6 aa, Drosophila melanogaster
KCSRPR

SEQ ID NO: 22091 - protein, 6 aa, Drosophila melanogaster
KCSRPR

SEQ ID NO: 22092 - protein, 6 aa, Drosophila melanogaster
KCSRPR

SEQ ID NO: 22093 - protein, 5 aa, Drosophila melanogaster
KKCSR

SEQ ID NO: 22094 - protein, 4 aa, Drosophila melanogaster
KCSR

SEQ ID NO: 22095 - protein, 4 aa, Drosophila melanogaster
KCSR

SEQ ID NO: 22096 - protein, 4 aa, Drosophila melanogaster
KCSR

SEQ ID NO: 22097 - protein, 6 aa, Drosophila melanogaster
KCSRPR

SEQ ID NO: 22098 - protein, 6 aa, Drosophila melanogaster
KCSRPR

SEQ ID NO: 22099 - protein, 4 aa, Drosophila melanogaster
KCSR

SEQ ID NO: 22100 - protein, 4 aa, Drosophila melanogaster
KCSR

SEQ ID NO: 22101 - protein, 12 aa, Drosophila melanogaster
RTNANVEGTPKR

SEQ ID NO: 22102 - protein, 12 aa, Drosophila melanogaster
RTNANVEGTPKR

SEQ ID NO: 22103 - protein, 12 aa, Drosophila melanogaster
RTNANVEGTPKR

SEQ ID NO: 22104 - protein, 12 aa, Drosophila melanogaster
RTNANVEGTPKR

SEQ ID NO: 22105 - protein, 4 aa, Drosophila melanogaster
VKQR

SEQ ID NO: 22106 - protein, 4 aa, Drosophila melanogaster
VKQR

SEQ ID NO: 22107 - protein, 10 aa, Drosophila melanogaster
KNAVEGESDR

SEQ ID NO: 22108 - protein, 11 aa, Drosophila melanogaster
TNANVEGTPKR

SEQ ID NO: 22109 - protein, 11 aa, Drosophila melanogaster
KNAVEGESDRK

SEQ ID NO: 22110 - protein, 11 aa, Drosophila melanogaster
KNAVEGESDRK

SEQ ID NO: 22111 - protein, 10 aa, Drosophila melanogaster
KNAVEGESDR

SEQ ID NO: 22112 - protein, 10 aa, Drosophila melanogaster
KNAVEGESDR

SEQ ID NO: 22113 - protein, 10 aa, Drosophila melanogaster
KNAVEGESDR

SEQ ID NO: 22114 - protein, 10 aa, Drosophila melanogaster
KNAVEGESDR

SEQ ID NO: 22115 - protein, 10 aa, Drosophila melanogaster
KNAVEGESDR

SEQ ID NO: 22116 - protein, 10 aa, Drosophila melanogaster
KNAVEGESDR

SEQ ID NO: 22117 - protein, 11 aa, Drosophila melanogaster
TNANVEGTPKR

SEQ ID NO: 22118 - protein, 12 aa, Drosophila melanogaster
RTNANVEGTPKR

SEQ ID NO: 22119 - protein, 10 aa, Drosophila melanogaster
KNAVEGESDR

SEQ ID NO: 22120 - protein, 11 aa, Drosophila melanogaster
TNANVEGTPKR

SEQ ID NO: 22121 - protein, 11 aa, Drosophila melanogaster
RKNAVEGESDR

SEQ ID NO: 22122 - protein, 11 aa, Drosophila melanogaster
RKNAVEGESDR

SEQ ID NO: 22123 - protein, 12 aa, Drosophila melanogaster
RTNANVEGTPKR

SEQ ID NO: 22124 - protein, 10 aa, Drosophila melanogaster
KNAVEGESDR

SEQ ID NO: 22125 - protein, 10 aa, Drosophila melanogaster
KNAVEGESDR

SEQ ID NO: 22126 - protein, 11 aa, Drosophila melanogaster
KNAVEGESDRK

SEQ ID NO: 22127 - protein, 12 aa, Drosophila melanogaster
RTNANVEGTPKR

SEQ ID NO: 22128 - protein, 11 aa, Drosophila melanogaster
RKNAVEGESDR

SEQ ID NO: 22129 - protein, 10 aa, Drosophila melanogaster
KNAVEGESDR

SEQ ID NO: 22130 - protein, 12 aa, Drosophila melanogaster
RTNANVEGTPKR

SEQ ID NO: 22131 - protein, 10 aa, Drosophila melanogaster
KNAVEGESDR

SEQ ID NO: 22132 - protein, 11 aa, Drosophila melanogaster
TNANVEGTPKR

SEQ ID NO: 22133 - protein, 10 aa, Drosophila melanogaster
KNAVEGESDR

SEQ ID NO: 22134 - protein, 10 aa, Drosophila melanogaster
KNAVEGESDR

SEQ ID NO: 22135 - protein, 10 aa, Drosophila melanogaster
KNAVEGESDR

SEQ ID NO: 22136 - protein, 11 aa, Drosophila melanogaster
TNANVEGTPKR

SEQ ID NO: 22137 - protein, 10 aa, Drosophila melanogaster
KNAVEGESDR

SEQ ID NO: 22138 - protein, 11 aa, Drosophila melanogaster
RKNAVEGESDR

SEQ ID NO: 22139 - protein, 11 aa, Drosophila melanogaster
RKNAVEGESDR

SEQ ID NO: 22140 - protein, 10 aa, Drosophila melanogaster
KNAVEGESDR

SEQ ID NO: 22141 - protein, 11 aa, Drosophila melanogaster
RKNAVEGESDR

SEQ ID NO: 22142 - protein, 11 aa, Drosophila melanogaster
RKNAVEGESDR

SEQ ID NO: 22143 - protein, 11 aa, Drosophila melanogaster
RKNAVEGESDR

SEQ ID NO: 22144 - protein, 11 aa, Drosophila melanogaster
RKNAVEGESDR

SEQ ID NO: 22145 - protein, 10 aa, Drosophila melanogaster
KNAVEGESDR

SEQ ID NO: 22146 - protein, 10 aa, Drosophila melanogaster
KNAVEGESDR

SEQ ID NO: 22147 - protein, 11 aa, Drosophila melanogaster
RKNAVEGESDR

SEQ ID NO: 22148 - protein, 11 aa, Drosophila melanogaster
RKNAVEGESDR

SEQ ID NO: 22149 - protein, 11 aa, Drosophila melanogaster
RKNAVEGESDR

SEQ ID NO: 22150 - protein, 11 aa, Drosophila melanogaster
TNANVEGTPKR

SEQ ID NO: 22151 - protein, 11 aa, Drosophila melanogaster
RKNAVEGESDR

SEQ ID NO: 22152 - protein, 12 aa, Drosophila melanogaster
RTNANVEGTPKR

SEQ ID NO: 22153 - protein, 11 aa, Drosophila melanogaster
TNANVEGTPKR

SEQ ID NO: 22154 - protein, 11 aa, Drosophila melanogaster
RKNAVEGESDR

SEQ ID NO: 22155 - protein, 10 aa, Drosophila melanogaster
KNAVEGESDR

SEQ ID NO: 22156 - protein, 11 aa, Drosophila melanogaster
RKNAVEGESDR

SEQ ID NO: 22157 - protein, 10 aa, Drosophila melanogaster
KNAVEGESDR

SEQ ID NO: 22158 - protein, 12 aa, Drosophila melanogaster
RTNANVEGTPKR

SEQ ID NO: 22159 - protein, 11 aa, Drosophila melanogaster
TNANVEGTPKR

SEQ ID NO: 22160 - protein, 11 aa, Drosophila melanogaster
TNANVEGTPKR

SEQ ID NO: 22161 - protein, 11 aa, Drosophila melanogaster
RKNAVEGESDR

SEQ ID NO: 22162 - protein, 10 aa, Drosophila melanogaster
KNAVEGESDR

SEQ ID NO: 22163 - protein, 12 aa, Drosophila melanogaster
RTNANVEGTPKR

SEQ ID NO: 22164 - protein, 11 aa, Drosophila melanogaster
RKNAVEGESDR

SEQ ID NO: 22165 - protein, 10 aa, Drosophila melanogaster
KNAVEGESDR

SEQ ID NO: 22166 - protein, 11 aa, Drosophila melanogaster
KNAVEGESDRK

SEQ ID NO: 22167 - protein, 11 aa, Drosophila melanogaster
RKNAVEGESDR

SEQ ID NO: 22168 - protein, 11 aa, Drosophila melanogaster
RKNAVEGESDR

SEQ ID NO: 22169 - protein, 10 aa, Drosophila melanogaster
KNAVEGESDR

SEQ ID NO: 22170 - protein, 12 aa, Drosophila melanogaster
RTNANVEGTPKR

SEQ ID NO: 22171 - protein, 12 aa, Drosophila melanogaster
RTNANVEGTPKR

SEQ ID NO: 22172 - protein, 6 aa, Drosophila melanogaster
KGGGNR

SEQ ID NO: 22173 - protein, 6 aa, Drosophila melanogaster
KGGGNR

SEQ ID NO: 22174 - protein, 6 aa, Drosophila melanogaster
KGGGNR

SEQ ID NO: 22175 - protein, 6 aa, Drosophila melanogaster
KGGGNR

SEQ ID NO: 22176 - protein, 6 aa, Drosophila melanogaster
KGGGNR

SEQ ID NO: 22177 - protein, 11 aa, Drosophila melanogaster
TNANVEGTPKR

SEQ ID NO: 22178 - protein, 6 aa, Drosophila melanogaster
KGGGNR

SEQ ID NO: 22179 - protein, 6 aa, Drosophila melanogaster
KGGGNR

SEQ ID NO: 22180 - protein, 6 aa, Drosophila melanogaster
KGGGNR

SEQ ID NO: 22181 - protein, 6 aa, Drosophila melanogaster
KGGGNR

SEQ ID NO: 22182 - protein, 6 aa, Drosophila melanogaster
KGGGNR

SEQ ID NO: 22183 - protein, 7 aa, Drosophila melanogaster
KGGGNRR

SEQ ID NO: 22184 - protein, 6 aa, Drosophila melanogaster
KGGGNR

SEQ ID NO: 22185 - protein, 6 aa, Drosophila melanogaster
KGGGNR

SEQ ID NO: 22186 - protein, 6 aa, Drosophila melanogaster
KGGGNR

SEQ ID NO: 22187 - protein, 13 aa, Drosophila melanogaster
TNANVEGTPKRGR

SEQ ID NO: 22188 - protein, 6 aa, Drosophila melanogaster
KGGGNR

SEQ ID NO: 22189 - protein, 11 aa, Drosophila melanogaster
TNANVEGTPKR

SEQ ID NO: 22190 - protein, 7 aa, Drosophila melanogaster
KGGGNRR

SEQ ID NO: 22191 - protein, 6 aa, Drosophila melanogaster
KGGGNR

SEQ ID NO: 22192 - protein, 6 aa, Drosophila melanogaster
KGGGNR

SEQ ID NO: 22193 - protein, 6 aa, Drosophila melanogaster
KGGGNR

SEQ ID NO: 22194 - protein, 6 aa, Drosophila melanogaster
KGGGNR

SEQ ID NO: 22195 - protein, 7 aa, Drosophila melanogaster
KGGGNRR

SEQ ID NO: 22196 - protein, 6 aa, Drosophila melanogaster
KGGGNR

SEQ ID NO: 22197 - protein, 6 aa, Drosophila melanogaster
KGGGNR

SEQ ID NO: 22198 - protein, 7 aa, Drosophila melanogaster
KGGGNRR

SEQ ID NO: 22199 - protein, 12 aa, Drosophila melanogaster
RTNANVEGTPKR

SEQ ID NO: 22200 - protein, 6 aa, Drosophila melanogaster
KGGGNR

SEQ ID NO: 22201 - protein, 12 aa, Drosophila melanogaster
RTNANVEGTPKR

SEQ ID NO: 22202 - protein, 7 aa, Drosophila melanogaster
KGGGNRR

SEQ ID NO: 22203 - protein, 12 aa, Drosophila melanogaster
RTNANVEGTPKR

SEQ ID NO: 22204 - protein, 6 aa, Drosophila melanogaster
KGGGNR

SEQ ID NO: 22205 - protein, 12 aa, Drosophila melanogaster
RTNANVEGTPKR

SEQ ID NO: 22206 - protein, 11 aa, Drosophila melanogaster
TNANVEGTPKR

SEQ ID NO: 22207 - protein, 6 aa, Drosophila melanogaster
KGGGNR

SEQ ID NO: 22208 - protein, 16 aa, Drosophila melanogaster
KTNMPEELVSCSDCGR

SEQ ID NO: 22209 - protein, 16 aa, Drosophila melanogaster
KTNMPEELVSCSDCGR

SEQ ID NO: 22210 - protein, 16 aa, Drosophila melanogaster
KTNMPEELVSCSDCGR

SEQ ID NO: 22211 - protein, 19 aa, Drosophila melanogaster
SGHPSCLQFTANMIISVKR

SEQ ID NO: 22212 - protein, 19 aa, Drosophila melanogaster
SGHPSCLQFTANMIISVKR

SEQ ID NO: 22213 - protein, 19 aa, Drosophila melanogaster
SGHPSCLQFTANMIISVKR

SEQ ID NO: 22214 - protein, 19 aa, Drosophila melanogaster
SGHPSCLQFTANMIISVKR

SEQ ID NO: 22215 - protein, 14 aa, Drosophila melanogaster
MNKAVMNHHANAER

SEQ ID NO: 22216 - protein, 14 aa, Drosophila melanogaster
MNKAVMNHHANAER

SEQ ID NO: 22217 - protein, 14 aa, Drosophila melanogaster
MNKAVMNHHANAER

SEQ ID NO: 22218 - protein, 14 aa, Drosophila melanogaster
MNKAVMNHHANAER

SEQ ID NO: 22219 - protein, 14 aa, Drosophila melanogaster
MNKAVMNHHANAER

SEQ ID NO: 22220 - protein, 14 aa, Drosophila melanogaster
MNKAVMNHHANAER

SEQ ID NO: 22221 - protein, 14 aa, Drosophila melanogaster
MNKAVMNHHANAER

SEQ ID NO: 22222 - protein, 14 aa, Drosophila melanogaster
MNKAVMNHHANAER

SEQ ID NO: 22223 - protein, 14 aa, Drosophila melanogaster
VEYIIKCDMSALQR

SEQ ID NO: 22224 - protein, 14 aa, Drosophila melanogaster
VEYIIKCDMSALQR

SEQ ID NO: 22225 - protein, 9 aa, Drosophila melanogaster
QHKDDQMKK

SEQ ID NO: 22226 - protein, 9 aa, Drosophila melanogaster
QHKDDQMKK

SEQ ID NO: 22227 - protein, 8 aa, Drosophila melanogaster
QHKDDQMK

SEQ ID NO: 22228 - protein, 22 aa, Drosophila melanogaster
LNMDEKVIQAGMFDQKSTGSER

SEQ ID NO: 22229 - protein, 5 aa, Drosophila melanogaster
IEKER

SEQ ID NO: 22230 - protein, 14 aa, Drosophila melanogaster
MNKAVMNHHANAER

SEQ ID NO: 22231 - protein, 14 aa, Drosophila melanogaster
MNKAVMNHHANAER

SEQ ID NO: 22232 - protein, 14 aa, Drosophila melanogaster
MNKAVMNHHANAER

SEQ ID NO: 22233 - protein, 14 aa, Drosophila melanogaster
MNKAVMNHHANAER

SEQ ID NO: 22234 - protein, 14 aa, Drosophila melanogaster
MNKAVMNHHANAER

SEQ ID NO: 22235 - protein, 14 aa, Drosophila melanogaster
MNKAVMNHHANAER

SEQ ID NO: 22236 - protein, 14 aa, Drosophila melanogaster
MNKAVMNHHANAER

SEQ ID NO: 22237 - protein, 12 aa, Drosophila melanogaster
TLSEPFMKLPSR

SEQ ID NO: 22238 - protein, 12 aa, Drosophila melanogaster
TLSEPFMKLPSR

SEQ ID NO: 22239 - protein, 5 aa, Drosophila melanogaster
KILQR

SEQ ID NO: 22240 - protein, 5 aa, Drosophila melanogaster
KILQR

SEQ ID NO: 22241 - protein, 5 aa, Drosophila melanogaster
KILQR

SEQ ID NO: 22242 - protein, 14 aa, Drosophila melanogaster
LTGDDAPMLKHLHR

SEQ ID NO: 22243 - protein, 14 aa, Drosophila melanogaster
LTGDDAPMLKHLHR

SEQ ID NO: 22244 - protein, 14 aa, Drosophila melanogaster
LTGDDAPMLKHLHR

SEQ ID NO: 22245 - protein, 8 aa, Drosophila melanogaster
EQKKEQER

SEQ ID NO: 22246 - protein, 9 aa, Drosophila melanogaster
AKVEDDEYR

SEQ ID NO: 22247 - protein, 17 aa, Drosophila melanogaster
ATSKHQHLNGNQVNLLR

SEQ ID NO: 22248 - protein, 8 aa, Drosophila melanogaster
EQKKEQER

SEQ ID NO: 22249 - protein, 8 aa, Drosophila melanogaster
EQKKEQER

SEQ ID NO: 22250 - protein, 8 aa, Drosophila melanogaster
EQKKEQER

SEQ ID NO: 22251 - protein, 10 aa, Drosophila melanogaster
SEEEIEIFKR

SEQ ID NO: 22252 - protein, 10 aa, Drosophila melanogaster
SEEEIEIFKR

SEQ ID NO: 22253 - protein, 11 aa, Drosophila melanogaster
KKEDEEIHPGR

SEQ ID NO: 22254 - protein, 10 aa, Drosophila melanogaster
SEEEIEIFKR

SEQ ID NO: 22255 - protein, 10 aa, Drosophila melanogaster
SEEEIEIFKR

SEQ ID NO: 22256 - protein, 10 aa, Drosophila melanogaster
SEEEIEIFKR

SEQ ID NO: 22257 - protein, 10 aa, Drosophila melanogaster
SEEEIEIFKR

SEQ ID NO: 22258 - protein, 10 aa, Drosophila melanogaster
SEEEIEIFKR

SEQ ID NO: 22259 - protein, 11 aa, Drosophila melanogaster
KKEDEEIHPGR

SEQ ID NO: 22260 - protein, 10 aa, Drosophila melanogaster
SEEEIEIFKR

SEQ ID NO: 22261 - protein, 11 aa, Drosophila melanogaster
KKEDEEIHPGR

SEQ ID NO: 22262 - protein, 10 aa, Drosophila melanogaster
SEEEIEIFKR

SEQ ID NO: 22263 - protein, 10 aa, Drosophila melanogaster
SEEEIEIFKR

SEQ ID NO: 22264 - protein, 11 aa, Drosophila melanogaster
KKEDEEIHPGR

SEQ ID NO: 22265 - protein, 10 aa, Drosophila melanogaster
SEEEIEIFKR

SEQ ID NO: 22266 - protein, 10 aa, Drosophila melanogaster
SEEEIEIFKR

SEQ ID NO: 22267 - protein, 11 aa, Drosophila melanogaster
KKEDEEIHPGR

SEQ ID NO: 22268 - protein, 26 aa, Drosophila melanogaster
RIDIQPAEDEDDQDEGYTTKHLAYAR

SEQ ID NO: 22269 - protein, 13 aa, Drosophila melanogaster
VKTDVDMHETPSR

SEQ ID NO: 22270 - protein, 13 aa, Drosophila melanogaster
VKTDVDMHETPSR

SEQ ID NO: 22271 - protein, 14 aa, Drosophila melanogaster
MVESSEAFQEELKR

SEQ ID NO: 22272 - protein, 14 aa, Drosophila melanogaster
MVESSEAFQEELKR

SEQ ID NO: 22273 - protein, 13 aa, Drosophila melanogaster
HCKPAVDEETFQK

SEQ ID NO: 22274 - protein, 14 aa, Drosophila melanogaster
MVESSEAFQEELKR

SEQ ID NO: 22275 - protein, 17 aa, Drosophila melanogaster
HCKPAVDEETFQKMVLR

SEQ ID NO: 22276 - protein, 13 aa, Drosophila melanogaster
HCKPAVDEETFQK

SEQ ID NO: 22277 - protein, 13 aa, Drosophila melanogaster
HCKPAVDEETFQK

SEQ ID NO: 22278 - protein, 14 aa, Drosophila melanogaster
MVESSEAFQEELKR

SEQ ID NO: 22279 - protein, 13 aa, Drosophila melanogaster
HCKPAVDEETFQK

SEQ ID NO: 22280 - protein, 14 aa, Drosophila melanogaster
MVESSEAFQEELKR

SEQ ID NO: 22281 - protein, 14 aa, Drosophila melanogaster
MVESSEAFQEELKR

SEQ ID NO: 22282 - protein, 13 aa, Drosophila melanogaster
HCKPAVDEETFQK

SEQ ID NO: 22283 - protein, 17 aa, Drosophila melanogaster
HCKPAVDEETFQKMVLR

SEQ ID NO: 22284 - protein, 14 aa, Drosophila melanogaster
MVESSEAFQEELKR

SEQ ID NO: 22285 - protein, 18 aa, Drosophila melanogaster
SLKAYHQTPAYQAYMSAK

SEQ ID NO: 22286 - protein, 11 aa, Drosophila melanogaster
SSSSKNQNESR

SEQ ID NO: 22287 - protein, 17 aa, Drosophila melanogaster
AYHQTPAYQAYMSAKSK

SEQ ID NO: 22288 - protein, 10 aa, Drosophila melanogaster
GGGSKSQHER

SEQ ID NO: 22289 - protein, 10 aa, Drosophila melanogaster
GGGSKSQHER

SEQ ID NO: 22290 - protein, 10 aa, Drosophila melanogaster
GGGSKSQHER

SEQ ID NO: 22291 - protein, 10 aa, Drosophila melanogaster
GGGSKSQHER

SEQ ID NO: 22292 - protein, 10 aa, Drosophila melanogaster
GGGSKSQHER

SEQ ID NO: 22293 - protein, 18 aa, Drosophila melanogaster
RLVSGGSSSSGAHAEGKK

SEQ ID NO: 22294 - protein, 5 aa, Drosophila melanogaster
KPEIK

SEQ ID NO: 22295 - protein, 24 aa, Drosophila melanogaster
QQQQLRPGPAGKQAASAGGSATVK

SEQ ID NO: 22296 - protein, 10 aa, Drosophila melanogaster
QKAWDIDTNR

SEQ ID NO: 22297 - protein, 10 aa, Drosophila melanogaster
QKAWDIDTNR

SEQ ID NO: 22298 - protein, 12 aa, Drosophila melanogaster
LGKNSADPPATR

SEQ ID NO: 22299 - protein, 12 aa, Drosophila melanogaster
LGKNSADPPATR

SEQ ID NO: 22300 - protein, 12 aa, Drosophila melanogaster
LGKNSADPPATR

SEQ ID NO: 22301 - protein, 12 aa, Drosophila melanogaster
LGKNSADPPATR

SEQ ID NO: 22302 - protein, 12 aa, Drosophila melanogaster
LGKNSADPPATR

SEQ ID NO: 22303 - protein, 8 aa, Drosophila melanogaster
TLLDLDKK

SEQ ID NO: 22304 - protein, 10 aa, Drosophila melanogaster
AKHLAALEER

SEQ ID NO: 22305 - protein, 10 aa, Drosophila melanogaster
AKHLAALEER

SEQ ID NO: 22306 - protein, 23 aa, Drosophila melanogaster
AAMEEFAAIKDEVPATIMDNHLK

SEQ ID NO: 22307 - protein, 23 aa, Drosophila melanogaster
AAMEEFAAIKDEVPATIMDNHLK

SEQ ID NO: 22308 - protein, 23 aa, Drosophila melanogaster
AAMEEFAAIKDEVPATIMDNHLK

SEQ ID NO: 22309 - protein, 23 aa, Drosophila melanogaster
AAMEEFAAIKDEVPATIMDNHLK

SEQ ID NO: 22310 - protein, 23 aa, Drosophila melanogaster
AAMEEFAAIKDEVPATIMDNHLK

SEQ ID NO: 22311 - protein, 23 aa, Drosophila melanogaster
AAMEEFAAIKDEVPATIMDNHLK

SEQ ID NO: 22312 - protein, 23 aa, Drosophila melanogaster
AAMEEFAAIKDEVPATIMDNHLK

SEQ ID NO: 22313 - protein, 23 aa, Drosophila melanogaster
KDGSPNIDFFQSPETLQGFESIR

SEQ ID NO: 22314 - protein, 11 aa, Drosophila melanogaster
SKTPEIYMAYR

SEQ ID NO: 22315 - protein, 30 aa, Drosophila melanogaster; identical to SEQ ID NO: 20374

SEQ ID NO: 22316 - protein, 30 aa, Drosophila melanogaster; identical to SEQ ID NO: 20374

SEQ ID NO: 22317 - protein, 30 aa, Drosophila melanogaster; identical to SEQ ID NO: 20374

SEQ ID NO: 22318 - protein, 30 aa, Drosophila melanogaster; identical to SEQ ID NO: 20374

SEQ ID NO: 22319 - protein, 30 aa, Drosophila melanogaster; identical to SEQ ID NO: 20374

SEQ ID NO: 22320 - protein, 30 aa, Drosophila melanogaster; identical to SEQ ID NO: 20374

SEQ ID NO: 22321 - protein, 12 aa, Drosophila melanogaster
TLLDLDKKPLGK

SEQ ID NO: 22322 - protein, 22 aa, Drosophila melanogaster
KDLYANTVLSGGTTMYPGIADR

SEQ ID NO: 22323 - protein, 22 aa, Drosophila melanogaster
KDLYANTVLSGGTTMYPGIADR

SEQ ID NO: 22324 - protein, 22 aa, Drosophila melanogaster
KDLYANTVLSGGTTMYPGIADR

SEQ ID NO: 22325 - protein, 22 aa, Drosophila melanogaster
KDLYANTVLSGGTTMYPGIADR

SEQ ID NO: 22326 - protein, 22 aa, Drosophila melanogaster
KDLYANTVLSGGTTMYPGIADR

SEQ ID NO: 22327 - protein, 22 aa, Drosophila melanogaster
KDLYANTVLSGGTTMYPGIADR

SEQ ID NO: 22328 - protein, 22 aa, Drosophila melanogaster
KDLYANTVLSGGTTMYPGIADR

SEQ ID NO: 22329 - protein, 13 aa, Drosophila melanogaster
KFYVDTNYVTVPR

SEQ ID NO: 22330 - protein, 13 aa, Drosophila melanogaster
KFYVDTNYVTVPR

SEQ ID NO: 22331 - protein, 13 aa, Drosophila melanogaster
KFYVDTNYVTVPR

SEQ ID NO: 22332 - protein, 13 aa, Drosophila melanogaster
KFYVDTNYVTVPR

SEQ ID NO: 22333 - protein, 13 aa, Drosophila melanogaster
KFYVDTNYVTVPR

SEQ ID NO: 22334 - protein, 13 aa, Drosophila melanogaster
KFYVDTNYVTVPR

SEQ ID NO: 22335 - protein, 13 aa, Drosophila melanogaster
KFYVDTNYVTVPR

SEQ ID NO: 22336 - protein, 13 aa, Drosophila melanogaster
KFYVDTNYVTVPR

SEQ ID NO: 22337 - protein, 13 aa, Drosophila melanogaster
KFYVDTNYVTVPR

SEQ ID NO: 22338 - protein, 13 aa, Drosophila melanogaster
KFYVDTNYVTVPR

SEQ ID NO: 22339 - protein, 40 aa, Drosophila melanogaster
ATALVVDSGATHTSAVPVHEGYVLSQAVVKSPLGGDFLSR

SEQ ID NO: 22340 - protein, 40 aa, Drosophila melanogaster; identical to SEQ ID NO: 22339

SEQ ID NO: 22341 - protein, 40 aa, Drosophila melanogaster; identical to SEQ ID NO: 22339

SEQ ID NO: 22342 - protein, 40 aa, Drosophila melanogaster; identical to SEQ ID NO: 22339

SEQ ID NO: 22343 - protein, 40 aa, Drosophila melanogaster; identical to SEQ ID NO: 22339

SEQ ID NO: 22344 - protein, 40 aa, Drosophila melanogaster; identical to SEQ ID NO: 22339

SEQ ID NO: 22345 - protein, 40 aa, Drosophila melanogaster; identical to SEQ ID NO: 22339

SEQ ID NO: 22346 - protein, 12 aa, Homo sapiens
KNIGKYSECGRR

SEQ ID NO: 22347 - protein, 12 aa, Homo sapiens
KNIGKYSECGRR

SEQ ID NO: 22348 - protein, 12 aa, Homo sapiens
KNIGKYSECGRR

SEQ ID NO: 22349 - protein, 12 aa, Homo sapiens
KNIGKYSECGRR

SEQ ID NO: 22350 - protein, 17 aa, Homo sapiens
KQDEPGQAGSQKSSTKQ

SEQ ID NO: 22351 - protein, 19 aa, Homo sapiens
RDLKIITDVIGNPEEERRA

SEQ ID NO: 22352 - protein, 19 aa, Homo sapiens
RDLKIITDVIGNPEEERRA

SEQ ID NO: 22353 - protein, 19 aa, Homo sapiens
RDLKIITDVIGNPEEERRA

SEQ ID NO: 22354 - protein, 19 aa, Homo sapiens
RDLKIITDVIGNPEEERRA

SEQ ID NO: 22355 - protein, 19 aa, Homo sapiens
RDLKIITDVIGNPEEERRA

SEQ ID NO: 22356 - protein, 19 aa, Homo sapiens
RDLKIITDVIGNPEEERRA

SEQ ID NO: 22357 - protein, 19 aa, Homo sapiens
RDLKIITDVIGNPEEERRA

SEQ ID NO: 22358 - protein, 19 aa, Homo sapiens
RDLKIITDVIGNPEEERRA

SEQ ID NO: 22359 - protein, 19 aa, Homo sapiens
RDLKIITDVIGNPEEERRA

SEQ ID NO: 22360 - protein, 19 aa, Homo sapiens
RDLKIITDVIGNPEEERRA

SEQ ID NO: 22361 - protein, 19 aa, Homo sapiens
RDLKIITDVIGNPEEERRA

SEQ ID NO: 22362 - protein, 19 aa, Homo sapiens
RDLKIITDVIGNPEEERRA

SEQ ID NO: 22363 - protein, 19 aa, Homo sapiens
RDLKIITDVIGNPEEERRA

SEQ ID NO: 22364 - protein, 19 aa, Homo sapiens
RDLKIITDVIGNPEEERRA

SEQ ID NO: 22365 - protein, 19 aa, Homo sapiens
RDLKIITDVIGNPEEERRA

SEQ ID NO: 22366 - protein, 19 aa, Homo sapiens
RDLKIITDVIGNPEEERRA

SEQ ID NO: 22367 - protein, 21 aa, Homo sapiens
RKRPAPQQIQQVQQQAVQNRN

SEQ ID NO: 22368 - protein, 23 aa, Homo sapiens
RTATTQETDGFQVKRPGDVNVRC

SEQ ID NO: 22369 - protein, 21 aa, Homo sapiens
RKRPAPQQIQQVQQQAVQNRN

SEQ ID NO: 22370 - protein, 21 aa, Homo sapiens
RKRPAPQQIQQVQQQAVQNRN

SEQ ID NO: 22371 - protein, 21 aa, Homo sapiens
RKRPAPQQIQQVQQQAVQNRN

SEQ ID NO: 22372 - protein, 25 aa, Homo sapiens
KDALLAGLKQDEPGQAGSQKSSTKQ

SEQ ID NO: 22373 - protein, 22 aa, Homo sapiens
RKPLVNGICDFDKGDGSHLSKN

SEQ ID NO: 22374 - protein, 29 aa, Homo sapiens
KENEMHVGSLLNGRKYSDSSLPPSNSGKI

SEQ ID NO: 22375 - protein, 29 aa, Homo sapiens
KENEMHVGSLLNGRKYSDSSLPPSNSGKI

SEQ ID NO: 22376 - protein, 18 aa, Homo sapiens
RLQSGVNTLQGFKEDKRN

SEQ ID NO: 22377 - protein, 18 aa, Homo sapiens
RLQSGVNTLQGFKEDKRN

SEQ ID NO: 22378 - protein, 18 aa, Homo sapiens
RLQSGVNTLQGFKEDKRN

SEQ ID NO: 22379 - protein, 11 aa, Homo sapiens
KKGPSTPYTKS

SEQ ID NO: 22380 - protein, 11 aa, Homo sapiens
KKGPSTPYTKS

SEQ ID NO: 22381 - protein, 28 aa, Homo sapiens
RTLDTAKEMEITEVEPPGRLDSSTQDRL

SEQ ID NO: 22382 - protein, 28 aa, Homo sapiens
RTLDTAKEMEITEVEPPGRLDSSTQDRL

SEQ ID NO: 22383 - protein, 15 aa, Homo sapiens
KLLHSGMKILSQERI

SEQ ID NO: 22384 - protein, 15 aa, Homo sapiens
KLLHSGMKILSQERI

SEQ ID NO: 22385 - protein, 30 aa, Homo sapiens
RRKPDGTTTLGLLHPVDPIVGEPGYCPVRL

SEQ ID NO: 22386 - protein, 30 aa, Homo sapiens; identical to SEQ ID NO: 22385

SEQ ID NO: 22387 - protein, 30 aa, Homo sapiens; identical to SEQ ID NO: 22385

SEQ ID NO: 22388 - protein, 16 aa, Homo sapiens
KHYKKYVHADAPTNKT

SEQ ID NO: 22389 - protein, 28 aa, Homo sapiens
RTLDTAKEMEITEVEPPGRLDSSTQDRL

SEQ ID NO: 22390 - protein, 28 aa, Homo sapiens
RTLDTAKEMEITEVEPPGRLDSSTQDRL

SEQ ID NO: 22391 - protein, 9 aa, Homo sapiens
RAKDDIKKV

SEQ ID NO: 22392 - protein, 9 aa, Homo sapiens
KKVQEAARA

SEQ ID NO: 22393 - protein, 19 aa, Homo sapiens
RDLKIITDVIGNPEEERRA

SEQ ID NO: 22394 - protein, 19 aa, Homo sapiens
RDLKIITDVIGNPEEERRA

SEQ ID NO: 22395 - protein, 19 aa, Homo sapiens
RDLKIITDVIGNPEEERRA

SEQ ID NO: 22396 - protein, 19 aa, Homo sapiens
RDLKIITDVIGNPEEERRA

SEQ ID NO: 22397 - protein, 17 aa, Homo sapiens
RVASAAAKAALEEFSRV

SEQ ID NO: 22398 - protein, 17 aa, Homo sapiens
RVASAAAKAALEEFSRV

SEQ ID NO: 22399 - protein, 17 aa, Homo sapiens
RVASAAAKAALEEFSRV

SEQ ID NO: 22400 - protein, 17 aa, Homo sapiens
RVASAAAKAALEEFSRV

SEQ ID NO: 22401 - protein, 17 aa, Homo sapiens
RVASAAAKAALEEFSRV

SEQ ID NO: 22402 - protein, 9 aa, Homo sapiens
KKVQEAARA

SEQ ID NO: 22403 - protein, 9 aa, Homo sapiens
KKVQEAARA

SEQ ID NO: 22404 - protein, 9 aa, Homo sapiens
KKVQEAARA

SEQ ID NO: 22405 - protein, 9 aa, Homo sapiens
KKVQEAARA

SEQ ID NO: 22406 - protein, 9 aa, Homo sapiens
KKVQEAARA

SEQ ID NO: 22407 - protein, 9 aa, Homo sapiens
KKVQEAARA

SEQ ID NO: 22408 - protein, 17 aa, Homo sapiens
RVASAAAKSALEEFSKM

SEQ ID NO: 22409 - protein, 14 aa, Homo sapiens
KEKPTDMQNFGLRT

SEQ ID NO: 22410 - protein, 17 aa, Homo sapiens
RVASAAAKAALEEFSRV

SEQ ID NO: 22411 - protein, 21 aa, Homo sapiens
RKRPAPQQIQQVQQQAVQNRN

SEQ ID NO: 22412 - protein, 11 aa, Homo sapiens
RYFYSKVQQRR

SEQ ID NO: 22413 - protein, 18 aa, Homo sapiens
RDLKTMTDVVGNPEEERR

SEQ ID NO: 22414 - protein, 9 aa, Homo sapiens
KKVQEAARA

SEQ ID NO: 22415 - protein, 9 aa, Homo sapiens
KKVQEAARA

SEQ ID NO: 22416 - protein, 9 aa, Homo sapiens
KKVQEAARA

SEQ ID NO: 22417 - protein, 9 aa, Homo sapiens
KKVQEAARA

SEQ ID NO: 22418 - protein, 9 aa, Homo sapiens
KKVQEAARA

SEQ ID NO: 22419 - protein, 9 aa, Homo sapiens
KKVQEAARA

SEQ ID NO: 22420 - protein, 29 aa, Homo sapiens
KKVEHEISEGNVATAAAAALASAATKAKH

SEQ ID NO: 22421 - protein, 17 aa, Homo sapiens
RKFLESTDSFNNELKRL

SEQ ID NO: 22422 - protein, 17 aa, Homo sapiens
RKFLESTDSFNNELKRL

SEQ ID NO: 22423 - protein, 18 aa, Homo sapiens
RVREEVPLELVEAHVKKV

SEQ ID NO: 22424 - protein, 18 aa, Homo sapiens
RVREEVPLELVEAHVKKV

SEQ ID NO: 22425 - protein, 18 aa, Homo sapiens
KRKHSPSPPPPTPTESRK

SEQ ID NO: 22426 - protein, 18 aa, Homo sapiens
RGQPLPDHLQMAVQGKRP

SEQ ID NO: 22427 - protein, 10 aa, Homo sapiens
RITPIQKPRG

SEQ ID NO: 22428 - protein, 21 aa, Homo sapiens
RKRPAPQQIQQVQQQAVQNRN

SEQ ID NO: 22429 - protein, 21 aa, Homo sapiens
RKRPAPQQIQQVQQQAVQNRN

SEQ ID NO: 22430 - protein, 14 aa, Homo sapiens
RLKLIANNTTVERR

SEQ ID NO: 22431 - protein, 10 aa, Homo sapiens
REQKKETERI

SEQ ID NO: 22432 - protein, 16 aa, Homo sapiens
KSKGAHTTMADALWRL

SEQ ID NO: 22433 - protein, 25 aa, Homo sapiens
RELFQEMNIELVPPYMIASKEAVRE

SEQ ID NO: 22434 - protein, 17 aa, Homo sapiens
RVASAAAKSALEEFSKM

SEQ ID NO: 22435 - protein, 12 aa, Homo sapiens
KVSYKGSPAARR

SEQ ID NO: 22436 - protein, 10 aa, Homo sapiens
RKYPDLERRD

SEQ ID NO: 22437 - protein, 10 aa, Homo sapiens
RKYPDLERRD

SEQ ID NO: 22438 - protein, 10 aa, Homo sapiens
RKYPDLERRD

SEQ ID NO: 22439 - protein, 15 aa, Homo sapiens
KHAEYSVILQEKERQ

SEQ ID NO: 22440 - protein, 15 aa, Homo sapiens
KHAEYSVILQEKERQ

SEQ ID NO: 22441 - protein, 13 aa, Homo sapiens
RDLSHKEKLYLRE

SEQ ID NO: 22442 - protein, 10 aa, Homo sapiens
RKYPDLERRD

SEQ ID NO: 22443 - protein, 10 aa, Homo sapiens
RKYPDLERRD

SEQ ID NO: 22444 - protein, 9 aa, Homo sapiens
RKYPDLERR

SEQ ID NO: 22445 - protein, 9 aa, Homo sapiens
RKYPDLERR

SEQ ID NO: 22446 - protein, 10 aa, Homo sapiens
RKYPDLERRD

SEQ ID NO: 22447 - protein, 10 aa, Homo sapiens
RKYPDLERRD

SEQ ID NO: 22448 - protein, 10 aa, Homo sapiens
KYKVLPTERT

SEQ ID NO: 22449 - protein, 23 aa, Homo sapiens
RTKVSSYPVALIPGQFQEYYKRY

SEQ ID NO: 22450 - protein, 17 aa, Homo sapiens
RQKHQEYLNSILQHAKD

SEQ ID NO: 22451 - protein, 13 aa, Homo sapiens
RKVEEAAKVTGKA

SEQ ID NO: 22452 - protein, 8 aa, Homo sapiens
RMQVLKRQ

SEQ ID NO: 22453 - protein, 16 aa, Homo sapiens
RQAFHMEQLKYAEMRA

SEQ ID NO: 22454 - protein, 8 aa, Homo sapiens
RMQVLKRQ

SEQ ID NO: 22455 - protein, 8 aa, Homo sapiens
RMQVLKRQ

SEQ ID NO: 22456 - protein, 8 aa, Homo sapiens
RMQVLKRQ

SEQ ID NO: 22457 - protein, 8 aa, Homo sapiens
RMQVLKRQ

SEQ ID NO: 22458 - protein, 14 aa, Homo sapiens
RKLEAELLQIEERH

SEQ ID NO: 22459 - protein, 18 aa, Homo sapiens
RKLEAELLQIEERHQEKK

SEQ ID NO: 22460 - protein, 14 aa, Homo sapiens
RKLEAELLQIEERH

SEQ ID NO: 22461 - protein, 14 aa, Homo sapiens
RKLEAELLQIEERH

SEQ ID NO: 22462 - protein, 18 aa, Homo sapiens
RKLEAELLQIEERHQEKK

SEQ ID NO: 22463 - protein, 18 aa, Homo sapiens
RKLEAELLQIEERHQEKK

SEQ ID NO: 22464 - protein, 14 aa, Homo sapiens
RKLEAELLQIEERH

SEQ ID NO: 22465 - protein, 14 aa, Homo sapiens
RKLEAELLQIEERH

SEQ ID NO: 22466 - protein, 18 aa, Homo sapiens
RKLEAELLQIEERHQEKK

SEQ ID NO: 22467 - protein, 11 aa, Homo sapiens
RHIFAKVQQRR

SEQ ID NO: 22468 - protein, 19 aa, Homo sapiens
RDLKIITDVIGNPEEERRA

SEQ ID NO: 22469 - protein, 19 aa, Homo sapiens
RDLKIITDVIGNPEEERRA

SEQ ID NO: 22470 - protein, 19 aa, Homo sapiens
RDLKIITDVIGNPEEERRA

SEQ ID NO: 22471 - protein, 17 aa, Homo sapiens
RVASAAAKSALEEFSKM

SEQ ID NO: 22472 - protein, 17 aa, Homo sapiens
RVASAAAKSALEEFSKM

SEQ ID NO: 22473 - protein, 21 aa, Homo sapiens
RDFMLSFSRDPKGYVQDLLRS

SEQ ID NO: 22474 - protein, 11 aa, Homo sapiens
KIKIIAPPERK

SEQ ID NO: 22475 - protein, 25 aa, Homo sapiens
RHQGVMVGMGQKDCYVGDEAQSKRG

SEQ ID NO: 22476 - protein, 19 aa, Homo sapiens
KKKIPDPDSDDVSEVDARH

SEQ ID NO: 22477 - protein, 15 aa, Homo sapiens
RDLTDYLMKILTERG

SEQ ID NO: 22478 - protein, 15 aa, Homo sapiens
RDLTDYLMKILTERG

SEQ ID NO: 22479 - protein, 21 aa, Homo sapiens
RLDLAGRDLTDYLMKILTERG

SEQ ID NO: 22480 - protein, 15 aa, Homo sapiens
RDLTDYLMKILTERG

SEQ ID NO: 22481 - protein, 15 aa, Homo sapiens
RDLTDYLMKILTERG

SEQ ID NO: 22482 - protein, 21 aa, Homo sapiens
RLDLAGRDLTDYLMKILTERG

SEQ ID NO: 22483 - protein, 15 aa, Homo sapiens
RDLTDYLMKILTERG

SEQ ID NO: 22484 - protein, 17 aa, Homo sapiens
RVASAAAKSALEEFSKM

SEQ ID NO: 22485 - protein, 17 aa, Homo sapiens
RVASAAAKSALEEFSKM

SEQ ID NO: 22486 - protein, 17 aa, Homo sapiens
RVASAAAKSALEEFSKM

SEQ ID NO: 22487 - protein, 19 aa, Homo sapiens
KEGQEEVLKEVVESEGERK

SEQ ID NO: 22488 - protein, 13 aa, Homo sapiens
KEPKEGQEEVLKE

SEQ ID NO: 22489 - protein, 13 aa, Homo sapiens
KEPKEGQEEVLKE

SEQ ID NO: 22490 - protein, 13 aa, Homo sapiens
KSKTPEIYLAYRN

SEQ ID NO: 22491 - protein, 20 aa, Homo sapiens
KPDSPEYKAACKLWDLYLRT

SEQ ID NO: 22492 - protein, 9 aa, Homo sapiens
RDLSHKEKL

SEQ ID NO: 22493 - protein, 12 aa, Homo sapiens
RAAKVAEQQERE

SEQ ID NO: 22494 - protein, 13 aa, Homo sapiens
RDVHLSKEQESRL

SEQ ID NO: 22495 - protein, 18 aa, Homo sapiens
RKEVDYSDSLTEKQWLKA

SEQ ID NO: 22496 - protein, 18 aa, Homo sapiens
RGQPLPDHLQMAVQGKRP

SEQ ID NO: 22497 - protein, 18 aa, Homo sapiens
RGQPLPDHLQMAVQGKRP

SEQ ID NO: 22498 - protein, 18 aa, Homo sapiens
RGQPLPDHLQMAVQGKRP

SEQ ID NO: 22499 - protein, 18 aa, Homo sapiens
RGQPLPDHLQMAVQGKRP

SEQ ID NO: 22500 - protein, 18 aa, Homo sapiens
RGQPLPDHLQMAVQGKRP

SEQ ID NO: 22501 - protein, 18 aa, Homo sapiens
RGQPLPDHLQMAVQGKRP

SEQ ID NO: 22502 - protein, 12 aa, Homo sapiens
RLDGTTKAEDRG

SEQ ID NO: 22503 - protein, 30 aa, Homo sapiens
KCAVLSFKDFLSCRPTEIPENDILLCESRY

SEQ ID NO: 22504 - protein, 21 aa, Homo sapiens
REAEKSEDSSGAAGLSGLHRT

SEQ ID NO: 22505 - protein, 17 aa, Homo sapiens
RVASAAAKAALEEFSRV

SEQ ID NO: 22506 - protein, 13 aa, Homo sapiens
RDVHLSKEQESRL

SEQ ID NO: 22507 - protein, 13 aa, Homo sapiens
RDVHLSKEQESRL

SEQ ID NO: 22508 - protein, 21 aa, Homo sapiens
REAEKSEDSSGAAGLSGLHRT

SEQ ID NO: 22509 - protein, 14 aa, Homo sapiens
MANSTGKAPPDERR

SEQ ID NO: 22510 - protein, 21 aa, Homo sapiens
RCTVLLMLDYQPPQFKLDPRL

SEQ ID NO: 22511 - protein, 21 aa, Homo sapiens
RCTVLLMLDYQPPQFKLDPRL

SEQ ID NO: 22512 - protein, 21 aa, Homo sapiens
RCTVLLMLDYQPPQFKLDPRL

SEQ ID NO: 22513 - protein, 14 aa, Homo sapiens
RKLEAELLQIEERH

SEQ ID NO: 22514 - protein, 10 aa, Homo sapiens
RKPVSFRQRI

SEQ ID NO: 22515 - protein, 10 aa, Homo sapiens
RKPVSFRQRI

SEQ ID NO: 22516 - protein, 24 aa, Homo sapiens
RKDLYANTVLSGGTTMYPGIADRM

SEQ ID NO: 22517 - protein, 35 aa, Homo sapiens; identical to SEQ ID NO: 728

SEQ ID NO: 22518 - protein, 16 aa, Homo sapiens
RMQKEITALAPSTMKI

SEQ ID NO: 22519 - protein, 16 aa, Homo sapiens
RMQKEITALAPSTMKI

SEQ ID NO: 22520 - protein, 9 aa, Homo sapiens
RAKDDIKRV

SEQ ID NO: 22521 - protein, 9 aa, Homo sapiens
RAKDDIKRV

SEQ ID NO: 22522 - protein, 9 aa, Homo sapiens
RAKDDIKRV

SEQ ID NO: 22523 - protein, 9 aa, Homo sapiens
RAKDDIKRV

SEQ ID NO: 22524 - protein, 8 aa, Homo sapiens
REQKAKRN

SEQ ID NO: 22525 - protein, 10 aa, Homo sapiens
NIGKYSECGR

SEQ ID NO: 22526 - protein, 10 aa, Homo sapiens
NIGKYSECGR

SEQ ID NO: 22527 - protein, 10 aa, Homo sapiens
NIGKYSECGR

SEQ ID NO: 22528 - protein, 10 aa, Homo sapiens
NIGKYSECGR

SEQ ID NO: 22529 - protein, 15 aa, Homo sapiens
QDEPGQAGSQKSSTK

SEQ ID NO: 22530 - protein, 17 aa, Homo sapiens
DLKIITDVIGNPEEERR

SEQ ID NO: 22531 - protein, 17 aa, Homo sapiens
DLKIITDVIGNPEEERR

SEQ ID NO: 22532 - protein, 17 aa, Homo sapiens
DLKIITDVIGNPEEERR

SEQ ID NO: 22533 - protein, 17 aa, Homo sapiens
DLKIITDVIGNPEEERR

SEQ ID NO: 22534 - protein, 17 aa, Homo sapiens
DLKIITDVIGNPEEERR

SEQ ID NO: 22535 - protein, 17 aa, Homo sapiens
DLKIITDVIGNPEEERR

SEQ ID NO: 22536 - protein, 17 aa, Homo sapiens
DLKIITDVIGNPEEERR

SEQ ID NO: 22537 - protein, 17 aa, Homo sapiens
DLKIITDVIGNPEEERR

SEQ ID NO: 22538 - protein, 17 aa, Homo sapiens
DLKIITDVIGNPEEERR

SEQ ID NO: 22539 - protein, 17 aa, Homo sapiens
DLKIITDVIGNPEEERR

SEQ ID NO: 22540 - protein, 17 aa, Homo sapiens
DLKIITDVIGNPEEERR

SEQ ID NO: 22541 - protein, 17 aa, Homo sapiens
DLKIITDVIGNPEEERR

SEQ ID NO: 22542 - protein, 17 aa, Homo sapiens
DLKIITDVIGNPEEERR

SEQ ID NO: 22543 - protein, 17 aa, Homo sapiens
DLKIITDVIGNPEEERR

SEQ ID NO: 22544 - protein, 17 aa, Homo sapiens
DLKIITDVIGNPEEERR

SEQ ID NO: 22545 - protein, 17 aa, Homo sapiens
DLKIITDVIGNPEEERR

SEQ ID NO: 22546 - protein, 19 aa, Homo sapiens
KRPAPQQIQQVQQQAVQNR

SEQ ID NO: 22547 - protein, 21 aa, Homo sapiens
TATTQETDGFQVKRPGDVNVR

SEQ ID NO: 22548 - protein, 19 aa, Homo sapiens
KRPAPQQIQQVQQQAVQNR

SEQ ID NO: 22549 - protein, 19 aa, Homo sapiens
KRPAPQQIQQVQQQAVQNR

SEQ ID NO: 22550 - protein, 19 aa, Homo sapiens
KRPAPQQIQQVQQQAVQNR

SEQ ID NO: 22551 - protein, 23 aa, Homo sapiens
DALLAGLKQDEPGQAGSQKSSTK

SEQ ID NO: 22552 - protein, 20 aa, Homo sapiens
KPLVNGICDFDKGDGSHLSK

SEQ ID NO: 22553 - protein, 27 aa, Homo sapiens
ENEMHVGSLLNGRKYSDSSLPPSNSGK

SEQ ID NO: 22554 - protein, 27 aa, Homo sapiens
ENEMHVGSLLNGRKYSDSSLPPSNSGK

SEQ ID NO: 22555 - protein, 16 aa, Homo sapiens
LQSGVNTLQGFKEDKR

SEQ ID NO: 22556 - protein, 16 aa, Homo sapiens
LQSGVNTLQGFKEDKR

SEQ ID NO: 22557 - protein, 16 aa, Homo sapiens
LQSGVNTLQGFKEDKR

SEQ ID NO: 22558 - protein, 9 aa, Homo sapiens
KGPSTPYTK

SEQ ID NO: 22559 - protein, 9 aa, Homo sapiens
KGPSTPYTK

SEQ ID NO: 22560 - protein, 26 aa, Homo sapiens
TLDTAKEMEITEVEPPGRLDSSTQDR

SEQ ID NO: 22561 - protein, 26 aa, Homo sapiens
TLDTAKEMEITEVEPPGRLDSSTQDR

SEQ ID NO: 22562 - protein, 13 aa, Homo sapiens
LLHSGMKILSQER

SEQ ID NO: 22563 - protein, 13 aa, Homo sapiens
LLHSGMKILSQER

SEQ ID NO: 22564 - protein, 28 aa, Homo sapiens
RKPDGTTTLGLLHPVDPIVGEPGYCPVR

SEQ ID NO: 22565 - protein, 28 aa, Homo sapiens
RKPDGTTTLGLLHPVDPIVGEPGYCPVR

SEQ ID NO: 22566 - protein, 28 aa, Homo sapiens
RKPDGTTTLGLLHPVDPIVGEPGYCPVR

SEQ ID NO: 22567 - protein, 14 aa, Homo sapiens
HYKKYVHADAPTNK

SEQ ID NO: 22568 - protein, 26 aa, Homo sapiens
TLDTAKEMEITEVEPPGRLDSSTQDR

SEQ ID NO: 22569 - protein, 26 aa, Homo sapiens
TLDTAKEMEITEVEPPGRLDSSTQDR

SEQ ID NO: 22570 - protein, 7 aa, Homo sapiens
AKDDIKK

SEQ ID NO: 22571 - protein, 7 aa, Homo sapiens
KVQEAAR

SEQ ID NO: 22572 - protein, 17 aa, Homo sapiens
DLKIITDVIGNPEEERR

SEQ ID NO: 22573 - protein, 17 aa, Homo sapiens
DLKIITDVIGNPEEERR

SEQ ID NO: 22574 - protein, 17 aa, Homo sapiens
DLKIITDVIGNPEEERR

SEQ ID NO: 22575 - protein, 17 aa, Homo sapiens
DLKIITDVIGNPEEERR

SEQ ID NO: 22576 - protein, 15 aa, Homo sapiens
VASAAAKAALEEFSR

SEQ ID NO: 22577 - protein, 15 aa, Homo sapiens
VASAAAKAALEEFSR

SEQ ID NO: 22578 - protein, 15 aa, Homo sapiens
VASAAAKAALEEFSR

SEQ ID NO: 22579 - protein, 15 aa, Homo sapiens
VASAAAKAALEEFSR

SEQ ID NO: 22580 - protein, 15 aa, Homo sapiens
VASAAAKAALEEFSR

SEQ ID NO: 22581 - protein, 7 aa, Homo sapiens
KVQEAAR

SEQ ID NO: 22582 - protein, 7 aa, Homo sapiens
KVQEAAR

SEQ ID NO: 22583 - protein, 7 aa, Homo sapiens
KVQEAAR

SEQ ID NO: 22584 - protein, 7 aa, Homo sapiens
KVQEAAR

SEQ ID NO: 22585 - protein, 7 aa, Homo sapiens
KVQEAAR

SEQ ID NO: 22586 - protein, 7 aa, Homo sapiens
KVQEAAR

SEQ ID NO: 22587 - protein, 15 aa, Homo sapiens
VASAAAKSALEEFSK

SEQ ID NO: 22588 - protein, 12 aa, Homo sapiens
EKPTDMQNFGLR

SEQ ID NO: 22589 - protein, 15 aa, Homo sapiens
VASAAAKAALEEFSR

SEQ ID NO: 22590 - protein, 19 aa, Homo sapiens
KRPAPQQIQQVQQQAVQNR

SEQ ID NO: 22591 - protein, 9 aa, Homo sapiens
YFYSKVQQR

SEQ ID NO: 22592 - protein, 16 aa, Homo sapiens
DLKTMTDVVGNPEEER

SEQ ID NO: 22593 - protein, 7 aa, Homo sapiens
KVQEAAR

SEQ ID NO: 22594 - protein, 7 aa, Homo sapiens
KVQEAAR

SEQ ID NO: 22595 - protein, 7 aa, Homo sapiens
KVQEAAR

SEQ ID NO: 22596 - protein, 7 aa, Homo sapiens
KVQEAAR

SEQ ID NO: 22597 - protein, 7 aa, Homo sapiens
KVQEAAR

SEQ ID NO: 22598 - protein, 7 aa, Homo sapiens
KVQEAAR

SEQ ID NO: 22599 - protein, 27 aa, Homo sapiens
KVEHEISEGNVATAAAAALASAATKAK

SEQ ID NO: 22600 - protein, 15 aa, Homo sapiens
KFLESTDSFNNELKR

SEQ ID NO: 22601 - protein, 15 aa, Homo sapiens
KFLESTDSFNNELKR

SEQ ID NO: 22602 - protein, 16 aa, Homo sapiens
VREEVPLELVEAHVKK

SEQ ID NO: 22603 - protein, 16 aa, Homo sapiens
VREEVPLELVEAHVKK

SEQ ID NO: 22604 - protein, 16 aa, Homo sapiens
RKHSPSPPPPTPTESR

SEQ ID NO: 22605 - protein, 16 aa, Homo sapiens
GQPLPDHLQMAVQGKR

SEQ ID NO: 22606 - protein, 8 aa, Homo sapiens
ITPIQKPR

SEQ ID NO: 22607 - protein, 19 aa, Homo sapiens
KRPAPQQIQQVQQQAVQNR

SEQ ID NO: 22608 - protein, 19 aa, Homo sapiens
KRPAPQQIQQVQQQAVQNR

SEQ ID NO: 22609 - protein, 12 aa, Homo sapiens
LKLIANNTTVER

SEQ ID NO: 22610 - protein, 8 aa, Homo sapiens
EQKKETER

SEQ ID NO: 22611 - protein, 14 aa, Homo sapiens
SKGAHTTMADALWR

SEQ ID NO: 22612 - protein, 23 aa, Homo sapiens
ELFQEMNIELVPPYMIASKEAVR

SEQ ID NO: 22613 - protein, 15 aa, Homo sapiens
VASAAAKSALEEFSK

SEQ ID NO: 22614 - protein, 10 aa, Homo sapiens
VSYKGSPAAR

SEQ ID NO: 22615 - protein, 8 aa, Homo sapiens
KYPDLERR

SEQ ID NO: 22616 - protein, 8 aa, Homo sapiens
KYPDLERR

SEQ ID NO: 22617 - protein, 8 aa, Homo sapiens
KYPDLERR

SEQ ID NO: 22618 - protein, 13 aa, Homo sapiens
HAEYSVILQEKER

SEQ ID NO: 22619 - protein, 13 aa, Homo sapiens
HAEYSVILQEKER

SEQ ID NO: 22620 - protein, 11 aa, Homo sapiens
DLSHKEKLYLR

SEQ ID NO: 22621 - protein, 8 aa, Homo sapiens
KYPDLERR

SEQ ID NO: 22622 - protein, 8 aa, Homo sapiens
KYPDLERR

SEQ ID NO: 22623 - protein, 7 aa, Homo sapiens
KYPDLER

SEQ ID NO: 22624 - protein, 7 aa, Homo sapiens
KYPDLER

SEQ ID NO: 22625 - protein, 8 aa, Homo sapiens
KYPDLERR

SEQ ID NO: 22626 - protein, 8 aa, Homo sapiens
KYPDLERR

SEQ ID NO: 22627 - protein, 8 aa, Homo sapiens
YKVLPTER

SEQ ID NO: 22628 - protein, 21 aa, Homo sapiens
TKVSSYPVALIPGQFQEYYKR

SEQ ID NO: 22629 - protein, 15 aa, Homo sapiens
QKHQEYLNSILQHAK

SEQ ID NO: 22630 - protein, 11 aa, Homo sapiens
KVEEAAKVTGK

SEQ ID NO: 22631 - protein, 6 aa, Homo sapiens
MQVLKR

SEQ ID NO: 22632 - protein, 14 aa, Homo sapiens
QAFHMEQLKYAEMR

SEQ ID NO: 22633 - protein, 6 aa, Homo sapiens
MQVLKR

SEQ ID NO: 22634 - protein, 6 aa, Homo sapiens
MQVLKR

SEQ ID NO: 22635 - protein, 6 aa, Homo sapiens
MQVLKR

SEQ ID NO: 22636 - protein, 6 aa, Homo sapiens
MQVLKR

SEQ ID NO: 22637 - protein, 12 aa, Homo sapiens
KLEAELLQIEER

SEQ ID NO: 22638 - protein, 16 aa, Homo sapiens
KLEAELLQIEERHQEK

SEQ ID NO: 22639 - protein, 12 aa, Homo sapiens
KLEAELLQIEER

SEQ ID NO: 22640 - protein, 12 aa, Homo sapiens
KLEAELLQIEER

SEQ ID NO: 22641 - protein, 16 aa, Homo sapiens
KLEAELLQIEERHQEK

SEQ ID NO: 22642 - protein, 16 aa, Homo sapiens
KLEAELLQIEERHQEK

SEQ ID NO: 22643 - protein, 12 aa, Homo sapiens
KLEAELLQIEER

SEQ ID NO: 22644 - protein, 12 aa, Homo sapiens
KLEAELLQIEER

SEQ ID NO: 22645 - protein, 16 aa, Homo sapiens
KLEAELLQIEERHQEK

SEQ ID NO: 22646 - protein, 9 aa, Homo sapiens
HIFAKVQQR

SEQ ID NO: 22647 - protein, 17 aa, Homo sapiens
DLKIITDVIGNPEEERR

SEQ ID NO: 22648 - protein, 17 aa, Homo sapiens
DLKIITDVIGNPEEERR

SEQ ID NO: 22649 - protein, 17 aa, Homo sapiens
DLKIITDVIGNPEEERR

SEQ ID NO: 22650 - protein, 15 aa, Homo sapiens
VASAAAKSALEEFSK

SEQ ID NO: 22651 - protein, 15 aa, Homo sapiens
VASAAAKSALEEFSK

SEQ ID NO: 22652 - protein, 19 aa, Homo sapiens
DFMLSFSRDPKGYVQDLLR

SEQ ID NO: 22653 - protein, 9 aa, Homo sapiens
IKIIAPPER

SEQ ID NO: 22654 - protein, 23 aa, Homo sapiens
HQGVMVGMGQKDCYVGDEAQSKR

SEQ ID NO: 22655 - protein, 17 aa, Homo sapiens
KKIPDPDSDDVSEVDAR

SEQ ID NO: 22656 - protein, 13 aa, Homo sapiens
DLTDYLMKILTER

SEQ ID NO: 22657 - protein, 13 aa, Homo sapiens
DLTDYLMKILTER

SEQ ID NO: 22658 - protein, 19 aa, Homo sapiens
LDLAGRDLTDYLMKILTER

SEQ ID NO: 22659 - protein, 13 aa, Homo sapiens
DLTDYLMKILTER

SEQ ID NO: 22660 - protein, 13 aa, Homo sapiens
DLTDYLMKILTER

SEQ ID NO: 22661 - protein, 19 aa, Homo sapiens
LDLAGRDLTDYLMKILTER

SEQ ID NO: 22662 - protein, 13 aa, Homo sapiens
DLTDYLMKILTER

SEQ ID NO: 22663 - protein, 15 aa, Homo sapiens
VASAAAKSALEEFSK

SEQ ID NO: 22664 - protein, 15 aa, Homo sapiens
VASAAAKSALEEFSK

SEQ ID NO: 22665 - protein, 15 aa, Homo sapiens
VASAAAKSALEEFSK

SEQ ID NO: 22666 - protein, 17 aa, Homo sapiens
EGQEEVLKEVVESEGER

SEQ ID NO: 22667 - protein, 11 aa, Homo sapiens
EPKEGQEEVLK

SEQ ID NO: 22668 - protein, 11 aa, Homo sapiens
EPKEGQEEVLK

SEQ ID NO: 22669 - protein, 11 aa, Homo sapiens
SKTPEIYLAYR

SEQ ID NO: 22670 - protein, 18 aa, Homo sapiens
PDSPEYKAACKLWDLYLR

SEQ ID NO: 22671 - protein, 7 aa, Homo sapiens
DLSHKEK

SEQ ID NO: 22672 - protein, 10 aa, Homo sapiens
AAKVAEQQER

SEQ ID NO: 22673 - protein, 11 aa, Homo sapiens
DVHLSKEQESR

SEQ ID NO: 22674 - protein, 16 aa, Homo sapiens
KEVDYSDSLTEKQWLK

SEQ ID NO: 22675 - protein, 16 aa, Homo sapiens
GQPLPDHLQMAVQGKR

SEQ ID NO: 22676 - protein, 16 aa, Homo sapiens
GQPLPDHLQMAVQGKR

SEQ ID NO: 22677 - protein, 16 aa, Homo sapiens
GQPLPDHLQMAVQGKR

SEQ ID NO: 22678 - protein, 16 aa, Homo sapiens
GQPLPDHLQMAVQGKR

SEQ ID NO: 22679 - protein, 16 aa, Homo sapiens
GQPLPDHLQMAVQGKR

SEQ ID NO: 22680 - protein, 16 aa, Homo sapiens
GQPLPDHLQMAVQGKR

SEQ ID NO: 22681 - protein, 10 aa, Homo sapiens
LDGTTKAEDR

SEQ ID NO: 22682 - protein, 28 aa, Homo sapiens
CAVLSFKDFLSCRPTEIPENDILLCESR

SEQ ID NO: 22683 - protein, 19 aa, Homo sapiens
EAEKSEDSSGAAGLSGLHR

SEQ ID NO: 22684 - protein, 15 aa, Homo sapiens
VASAAAKAALEEFSR

SEQ ID NO: 22685 - protein, 11 aa, Homo sapiens
DVHLSKEQESR

SEQ ID NO: 22686 - protein, 11 aa, Homo sapiens
DVHLSKEQESR

SEQ ID NO: 22687 - protein, 19 aa, Homo sapiens
EAEKSEDSSGAAGLSGLHR

SEQ ID NO: 22688 - protein, 13 aa, Homo sapiens
MANSTGKAPPDER

SEQ ID NO: 22689 - protein, 19 aa, Homo sapiens
CTVLLMLDYQPPQFKLDPR

SEQ ID NO: 22690 - protein, 19 aa, Homo sapiens
CTVLLMLDYQPPQFKLDPR

SEQ ID NO: 22691 - protein, 19 aa, Homo sapiens
CTVLLMLDYQPPQFKLDPR

SEQ ID NO: 22692 - protein, 12 aa, Homo sapiens
KLEAELLQIEER

SEQ ID NO: 22693 - protein, 8 aa, Homo sapiens
KPVSFRQR

SEQ ID NO: 22694 - protein, 8 aa, Homo sapiens
KPVSFRQR

SEQ ID NO: 22695 - protein, 22 aa, Homo sapiens
KDLYANTVLSGGTTMYPGIADR

SEQ ID NO: 22696 - protein, 33 aa, Homo sapiens; identical to SEQ ID NO: 2116

SEQ ID NO: 22697 - protein, 14 aa, Homo sapiens
MQKEITALAPSTMK

SEQ ID NO: 22698 - protein, 14 aa, Homo sapiens
MQKEITALAPSTMK

SEQ ID NO: 22699 - protein, 7 aa, Homo sapiens
AKDDIKR

SEQ ID NO: 22700 - protein, 7 aa, Homo sapiens
AKDDIKR

SEQ ID NO: 22701 - protein, 7 aa, Homo sapiens
AKDDIKR

SEQ ID NO: 22702 - protein, 7 aa, Homo sapiens
AKDDIKR

SEQ ID NO: 22703 - protein, 6 aa, Homo sapiens
EQKAKR

SEQ ID NO: 22704 - protein, 6 aa, Homo sapiens
RKVGRR

SEQ ID NO: 22705 - protein, 6 aa, Homo sapiens
RKVGRR

SEQ ID NO: 22706 - protein, 6 aa, Homo sapiens
RKVGRR

SEQ ID NO: 22707 - protein, 6 aa, Homo sapiens
RKVGRR

SEQ ID NO: 22708 - protein, 12 aa, Homo sapiens
RKMADKVLPQRI

SEQ ID NO: 22709 - protein, 13 aa, Homo sapiens
RKLGINDIEGQRV

SEQ ID NO: 22710 - protein, 13 aa, Homo sapiens
RKLGINDIEGQRV

SEQ ID NO: 22711 - protein, 13 aa, Homo sapiens
RKLGINDIEGQRV

SEQ ID NO: 22712 - protein, 13 aa, Homo sapiens
RKLGINDIEGQRV

SEQ ID NO: 22713 - protein, 13 aa, Homo sapiens
RKLGINDIEGQRV

SEQ ID NO: 22714 - protein, 13 aa, Homo sapiens
RKLGINDIEGQRV

SEQ ID NO: 22715 - protein, 13 aa, Homo sapiens
RKLGINDIEGQRV

SEQ ID NO: 22716 - protein, 13 aa, Homo sapiens
RKLGINDIEGQRV

SEQ ID NO: 22717 - protein, 13 aa, Homo sapiens
RKLGINDIEGQRV

SEQ ID NO: 22718 - protein, 13 aa, Homo sapiens
RKLGINDIEGQRV

SEQ ID NO: 22719 - protein, 13 aa, Homo sapiens
RKLGINDIEGQRV

SEQ ID NO: 22720 - protein, 13 aa, Homo sapiens
RKLGINDIEGQRV

SEQ ID NO: 22721 - protein, 13 aa, Homo sapiens
RKLGINDIEGQRV

SEQ ID NO: 22722 - protein, 13 aa, Homo sapiens
RKLGINDIEGQRV

SEQ ID NO: 22723 - protein, 13 aa, Homo sapiens
RKLGINDIEGQRV

SEQ ID NO: 22724 - protein, 13 aa, Homo sapiens
RKLGINDIEGQRV

SEQ ID NO: 22725 - protein, 16 aa, Homo sapiens
RGGILTSTGFYKCLRT

SEQ ID NO: 22726 - protein, 18 aa, Homo sapiens
KSSTKQPTVGGTSSTPRA

SEQ ID NO: 22727 - protein, 14 aa, Homo sapiens
RDFTDEKEGPITKH

SEQ ID NO: 22728 - protein, 14 aa, Homo sapiens
RDFTDEKEGPITKH

SEQ ID NO: 22729 - protein, 19 aa, Homo sapiens
RNLVFRDFTDEKEGPITKH

SEQ ID NO: 22730 - protein, 19 aa, Homo sapiens
RHMQAKGILLTDGSEKDKK

SEQ ID NO: 22731 - protein, 8 aa, Homo sapiens
RKRQEERE

SEQ ID NO: 22732 - protein, 22 aa, Homo sapiens
KLEGAEEEKMEADPDGQQPEKA

SEQ ID NO: 22733 - protein, 22 aa, Homo sapiens
KLEGAEEEKMEADPDGQQPEKA

SEQ ID NO: 22734 - protein, 17 aa, Homo sapiens
RDTALETALNAKAYKRS

SEQ ID NO: 22735 - protein, 17 aa, Homo sapiens
RRDTALETALNAKAYKR

SEQ ID NO: 22736 - protein, 17 aa, Homo sapiens
RDTALETALNAKAYKRS

SEQ ID NO: 22737 - protein, 7 aa, Homo sapiens
RKKGEKQ

SEQ ID NO: 22738 - protein, 7 aa, Homo sapiens
RKKGEKQ

SEQ ID NO: 22739 - protein, 9 aa, Homo sapiens
RKVEEAAKV

SEQ ID NO: 22740 - protein, 9 aa, Homo sapiens
RKVEEAAKV

SEQ ID NO: 22741 - protein, 11 aa, Homo sapiens
RDRKASANARK

SEQ ID NO: 22742 - protein, 11 aa, Homo sapiens
RDRKASANARK

SEQ ID NO: 22743 - protein, 7 aa, Homo sapiens
KKTLAKS

SEQ ID NO: 22744 - protein, 14 aa, Homo sapiens
KEKPVDLQNFGLRT

SEQ ID NO: 22745 - protein, 14 aa, Homo sapiens
KEKPVDLQNFGLRT

SEQ ID NO: 22746 - protein, 8 aa, Homo sapiens
KEDKRNKV

SEQ ID NO: 22747 - protein, 8 aa, Homo sapiens
RMQVLKRQ

SEQ ID NO: 22748 - protein, 8 aa, Homo sapiens
RMQVLKRQ

SEQ ID NO: 22749 - protein, 8 aa, Homo sapiens
KIQKLTKA

SEQ ID NO: 22750 - protein, 8 aa, Homo sapiens
RGSLYKRY

SEQ ID NO: 22751 - protein, 17 aa, Homo sapiens
RVASAAAKAALEEFSRV

SEQ ID NO: 22752 - protein, 17 aa, Homo sapiens
RVASAAAKAALEEFSRV

SEQ ID NO: 22753 - protein, 17 aa, Homo sapiens
RVASAAAKAALEEFSRV

SEQ ID NO: 22754 - protein, 17 aa, Homo sapiens
RVASAAAKAALEEFSRV

SEQ ID NO: 22755 - protein, 8 aa, Homo sapiens
RKTKVERD

SEQ ID NO: 22756 - protein, 17 aa, Homo sapiens
RVASAAAKSALEEFSKM

SEQ ID NO: 22757 - protein, 17 aa, Homo sapiens
RVASAAAKSALEEFSKM

SEQ ID NO: 22758 - protein, 11 aa, Homo sapiens
KSKAAASATRE

SEQ ID NO: 22759 - protein, 11 aa, Homo sapiens
KSKAAASATRE

SEQ ID NO: 22760 - protein, 8 aa, Homo sapiens
RKTKVERD

SEQ ID NO: 22761 - protein, 8 aa, Homo sapiens
RKTKVERD

SEQ ID NO: 22762 - protein, 9 aa, Homo sapiens
RKVEEAAKV

SEQ ID NO: 22763 - protein, 8 aa, Homo sapiens
RKTKVERD

SEQ ID NO: 22764 - protein, 8 aa, Homo sapiens
RKTKVERD

SEQ ID NO: 22765 - protein, 8 aa, Homo sapiens
RKTKVERD

SEQ ID NO: 22766 - protein, 9 aa, Homo sapiens
KKVQEAARA

SEQ ID NO: 22767 - protein, 7 aa, Homo sapiens
KKTLAKS

SEQ ID NO: 22768 - protein, 13 aa, Homo sapiens
RDPKGYVQDLLRS

SEQ ID NO: 22769 - protein, 9 aa, Homo sapiens
KKVQEAARA

SEQ ID NO: 22770 - protein, 9 aa, Homo sapiens
KKVQEAARA

SEQ ID NO: 22771 - protein, 17 aa, Homo sapiens
RVASAAAKAALEEFSRV

SEQ ID NO: 22772 - protein, 8 aa, Homo sapiens
RMQVLKRQ

SEQ ID NO: 22773 - protein, 8 aa, Homo sapiens
RMQVLKRQ

SEQ ID NO: 22774 - protein, 8 aa, Homo sapiens
RMQVLKRQ

SEQ ID NO: 22775 - protein, 8 aa, Homo sapiens
RMQVLKRQ

SEQ ID NO: 22776 - protein, 8 aa, Homo sapiens
RMQVLKRQ

SEQ ID NO: 22777 - protein, 8 aa, Homo sapiens
RMQVLKRQ

SEQ ID NO: 22778 - protein, 8 aa, Homo sapiens
RMQVLKRQ

SEQ ID NO: 22779 - protein, 11 aa, Homo sapiens
REKEALEQQRQ

SEQ ID NO: 22780 - protein, 11 aa, Homo sapiens
REKEALEQQRQ

SEQ ID NO: 22781 - protein, 8 aa, Homo sapiens
RMQVLKRQ

SEQ ID NO: 22782 - protein, 8 aa, Homo sapiens
RMQVLKRQ

SEQ ID NO: 22783 - protein, 12 aa, Homo sapiens
REKEAAEQAERS

SEQ ID NO: 22784 - protein, 17 aa, Homo sapiens
RVASAAAKSALEEFSKM

SEQ ID NO: 22785 - protein, 7 aa, Homo sapiens
RKMADKV

SEQ ID NO: 22786 - protein, 12 aa, Homo sapiens
RITEKLEKQQKI

SEQ ID NO: 22787 - protein, 10 aa, Homo sapiens
RITPIQKPRG

SEQ ID NO: 22788 - protein, 9 aa, Homo sapiens
KDFKEYHRS

SEQ ID NO: 22789 - protein, 10 aa, Homo sapiens
KEKLPQVTRS

SEQ ID NO: 22790 - protein, 14 aa, Homo sapiens
RLKLIANNTTVERR

SEQ ID NO: 22791 - protein, 15 aa, Homo sapiens
RLTCEEEEEKMFGRG

SEQ ID NO: 22792 - protein, 10 aa, Homo sapiens
KYKVLPTERT

SEQ ID NO: 22793 - protein, 9 aa, Homo sapiens
RKYPDLERR

SEQ ID NO: 22794 - protein, 12 aa, Homo sapiens
KVSYKGSPAARR

SEQ ID NO: 22795 - protein, 12 aa, Homo sapiens
KVSYKGSPAARR

SEQ ID NO: 22796 - protein, 12 aa, Homo sapiens
KVSYKGSPAARR

SEQ ID NO: 22797 - protein, 8 aa, Homo sapiens
REQKAKRN

SEQ ID NO: 22798 - protein, 8 aa, Homo sapiens
RGSLYKRY

SEQ ID NO: 22799 - protein, 8 aa, Homo sapiens
RGSLYKRY

SEQ ID NO: 22800 - protein, 8 aa, Homo sapiens
REQKAKRN

SEQ ID NO: 22801 - protein, 8 aa, Homo sapiens
RGSLYKRY

SEQ ID NO: 22802 - protein, 8 aa, Homo sapiens
REQKAKRN

SEQ ID NO: 22803 - protein, 8 aa, Homo sapiens
REQKAKRN

SEQ ID NO: 22804 - protein, 8 aa, Homo sapiens
REQKAKRN

SEQ ID NO: 22805 - protein, 8 aa, Homo sapiens
REQKAKRN

SEQ ID NO: 22806 - protein, 9 aa, Homo sapiens
RTDIYSKKT

SEQ ID NO: 22807 - protein, 17 aa, Homo sapiens
RVASAAAKAALEEFSRV

SEQ ID NO: 22808 - protein, 6 aa, Homo sapiens
RKVGRR

SEQ ID NO: 22809 - protein, 8 aa, Homo sapiens
RMQVLKRQ

SEQ ID NO: 22810 - protein, 8 aa, Homo sapiens
RKTKVERD

SEQ ID NO: 22811 - protein, 14 aa, Homo sapiens
RLCGLKVEVDMEKI

SEQ ID NO: 22812 - protein, 9 aa, Homo sapiens
RKVEEAAKV

SEQ ID NO: 22813 - protein, 9 aa, Homo sapiens
RKVEEAAKV

SEQ ID NO: 22814 - protein, 9 aa, Homo sapiens
RKVEEAAKV

SEQ ID NO: 22815 - protein, 9 aa, Homo sapiens
RKVEEAAKV

SEQ ID NO: 22816 - protein, 7 aa, Homo sapiens
KKLEIKL

SEQ ID NO: 22817 - protein, 7 aa, Homo sapiens
KKLEIKL

SEQ ID NO: 22818 - protein, 7 aa, Homo sapiens
KKLEIKL

SEQ ID NO: 22819 - protein, 7 aa, Homo sapiens
KKLEIKL

SEQ ID NO: 22820 - protein, 7 aa, Homo sapiens
KKLEIKL

SEQ ID NO: 22821 - protein, 7 aa, Homo sapiens
KKLEIKL

SEQ ID NO: 22822 - protein, 7 aa, Homo sapiens
KKLEIKL

SEQ ID NO: 22823 - protein, 7 aa, Homo sapiens
KKLEIKL

SEQ ID NO: 22824 - protein, 7 aa, Homo sapiens
KKLEIKL

SEQ ID NO: 22825 - protein, 9 aa, Homo sapiens
RKVEEAAKV

SEQ ID NO: 22826 - protein, 17 aa, Homo sapiens
RVASAAAKSALEEFSKM

SEQ ID NO: 22827 - protein, 17 aa, Homo sapiens
RVASAAAKSALEEFSKM

SEQ ID NO: 22828 - protein, 17 aa, Homo sapiens
RVASAAAKSALEEFSKM

SEQ ID NO: 22829 - protein, 13 aa, Homo sapiens
RDPKGYVQDLLRS

SEQ ID NO: 22830 - protein, 13 aa, Homo sapiens
RDPKGYVQDLLRS

SEQ ID NO: 22831 - protein, 17 aa, Homo sapiens
RVASAAAKSALEEFSKM

SEQ ID NO: 22832 - protein, 7 aa, Homo sapiens
RIEKERM

SEQ ID NO: 22833 - protein, 23 aa, Homo sapiens
RLPSHWLKSKGAHTTMADALWRL

SEQ ID NO: 22834 - protein, 11 aa, Homo sapiens
KIKIIAPPERK

SEQ ID NO: 22835 - protein, 10 aa, Homo sapiens
KEKLPQVTRS

SEQ ID NO: 22836 - protein, 10 aa, Homo sapiens
KEKLPQVTRS

SEQ ID NO: 22837 - protein, 10 aa, Homo sapiens
KEKLPQVTRS

SEQ ID NO: 22838 - protein, 11 aa, Homo sapiens
RKEKLPQVTRS

SEQ ID NO: 22839 - protein, 11 aa, Homo sapiens
RKEKLPQVTRS

SEQ ID NO: 22840 - protein, 10 aa, Homo sapiens
KEKLPQVTRS

SEQ ID NO: 22841 - protein, 11 aa, Homo sapiens
RKEKLPQVTRS

SEQ ID NO: 22842 - protein, 13 aa, Homo sapiens
RDVHLSKEQESRL

SEQ ID NO: 22843 - protein, 13 aa, Homo sapiens
RDVHLSKEQESRL

SEQ ID NO: 22844 - protein, 13 aa, Homo sapiens
RDVHLSKEQESRL

SEQ ID NO: 22845 - protein, 8 aa, Homo sapiens
RKEKLPKE

SEQ ID NO: 22846 - protein, 10 aa, Homo sapiens
KEIEEDKLKR

SEQ ID NO: 22847 - protein, 10 aa, Homo sapiens
KEIEEDKLKR

SEQ ID NO: 22848 - protein, 13 aa, Homo sapiens
RYNVPNSAIYKRV

SEQ ID NO: 22849 - protein, 8 aa, Homo sapiens
KEKLYLRE

SEQ ID NO: 22850 - protein, 7 aa, Homo sapiens
KLKLSRK

SEQ ID NO: 22851 - protein, 6 aa, Homo sapiens
RKVGRR

SEQ ID NO: 22852 - protein, 6 aa, Homo sapiens
RKVGRR

SEQ ID NO: 22853 - protein, 21 aa, Homo sapiens
REAEKSEDSSGAAGLSGLHRT

SEQ ID NO: 22854 - protein, 13 aa, Homo sapiens
RDVHLSKEQESRL

SEQ ID NO: 22855 - protein, 13 aa, Homo sapiens
RDVHLSKEQESRL

SEQ ID NO: 22856 - protein, 13 aa, Homo sapiens
RDVHLSKEQESRL

SEQ ID NO: 22857 - protein, 13 aa, Homo sapiens
RDVHLSKEQESRL

SEQ ID NO: 22858 - protein, 13 aa, Homo sapiens
RDVHLSKEQESRL

SEQ ID NO: 22859 - protein, 13 aa, Homo sapiens
RDVHLSKEQESRL

SEQ ID NO: 22860 - protein, 6 aa, Homo sapiens
KKNIRK

SEQ ID NO: 22861 - protein, 8 aa, Homo sapiens
RQKKSSRK

SEQ ID NO: 22862 - protein, 16 aa, Homo sapiens
KNKEKPVDLQNFGLRT

SEQ ID NO: 22863 - protein, 13 aa, Homo sapiens
RDVHLSKEQESRL

SEQ ID NO: 22864 - protein, 9 aa, Homo sapiens
KKVQEAARA

SEQ ID NO: 22865 - protein, 9 aa, Homo sapiens
KKVQEAARA

SEQ ID NO: 22866 - protein, 18 aa, Homo sapiens
KLNVDQKVIQAGMFDQKS

SEQ ID NO: 22867 - protein, 9 aa, Homo sapiens
KGKESNKKG

SEQ ID NO: 22868 - protein, 11 aa, Homo sapiens
KATVELKALRL

SEQ ID NO: 22869 - protein, 11 aa, Homo sapiens
KATVELKALRL

SEQ ID NO: 22870 - protein, 11 aa, Homo sapiens
KATVELKALRL

SEQ ID NO: 22871 - protein, 10 aa, Homo sapiens
KQQKIEQERK

SEQ ID NO: 22872 - protein, 7 aa, Homo sapiens
RNHKYRS

SEQ ID NO: 22873 - protein, 7 aa, Homo sapiens
RNHKYRS

SEQ ID NO: 22874 - protein, 14 aa, Homo sapiens
RRALPEFFNGKNKS

SEQ ID NO: 22875 - protein, 12 aa, Homo sapiens
RKGLAFLDELRQ

SEQ ID NO: 22876 - protein, 11 aa, Homo sapiens
REGSPANWKRK

SEQ ID NO: 22877 - protein, 9 aa, Homo sapiens
KQCVERKCP

SEQ ID NO: 22878 - protein, 8 aa, Homo sapiens
KIQKLTKA

SEQ ID NO: 22879 - protein, 8 aa, Homo sapiens
KIQKLTKA

SEQ ID NO: 22880 - protein, 8 aa, Homo sapiens
KIQKLTKA

SEQ ID NO: 22881 - protein, 8 aa, Homo sapiens
RGSLYKRY

SEQ ID NO: 22882 - protein, 9 aa, Homo sapiens
RAKDDIKRV

SEQ ID NO: 22883 - protein, 4 aa, Homo sapiens
KVGR

SEQ ID NO: 22884 - protein, 4 aa, Homo sapiens
KVGR

SEQ ID NO: 22885 - protein, 4 aa, Homo sapiens
KVGR

SEQ ID NO: 22886 - protein, 4 aa, Homo sapiens
KVGR

SEQ ID NO: 22887 - protein, 10 aa, Homo sapiens
KMADKVLPQR

SEQ ID NO: 22888 - protein, 11 aa, Homo sapiens
KLGINDIEGQR

SEQ ID NO: 22889 - protein, 11 aa, Homo sapiens
KLGINDIEGQR

SEQ ID NO: 22890 - protein, 11 aa, Homo sapiens
KLGINDIEGQR

SEQ ID NO: 22891 - protein, 11 aa, Homo sapiens
KLGINDIEGQR

SEQ ID NO: 22892 - protein, 11 aa, Homo sapiens
KLGINDIEGQR

SEQ ID NO: 22893 - protein, 11 aa, Homo sapiens
KLGINDIEGQR

SEQ ID NO: 22894 - protein, 11 aa, Homo sapiens
KLGINDIEGQR

SEQ ID NO: 22895 - protein, 11 aa, Homo sapiens
KLGINDIEGQR

SEQ ID NO: 22896 - protein, 11 aa, Homo sapiens
KLGINDIEGQR

SEQ ID NO: 22897 - protein, 11 aa, Homo sapiens
KLGINDIEGQR

SEQ ID NO: 22898 - protein, 11 aa, Homo sapiens
KLGINDIEGQR

SEQ ID NO: 22899 - protein, 11 aa, Homo sapiens
KLGINDIEGQR

SEQ ID NO: 22900 - protein, 11 aa, Homo sapiens
KLGINDIEGQR

SEQ ID NO: 22901 - protein, 11 aa, Homo sapiens
KLGINDIEGQR

SEQ ID NO: 22902 - protein, 11 aa, Homo sapiens
KLGINDIEGQR

SEQ ID NO: 22903 - protein, 11 aa, Homo sapiens
KLGINDIEGQR

SEQ ID NO: 22904 - protein, 14 aa, Homo sapiens
GGILTSTGFYKCLR

SEQ ID NO: 22905 - protein, 16 aa, Homo sapiens
SSTKQPTVGGTSSTPR

SEQ ID NO: 22906 - protein, 12 aa, Homo sapiens
DFTDEKEGPITK

SEQ ID NO: 22907 - protein, 12 aa, Homo sapiens
DFTDEKEGPITK

SEQ ID NO: 22908 - protein, 17 aa, Homo sapiens
NLVFRDFTDEKEGPITK

SEQ ID NO: 22909 - protein, 17 aa, Homo sapiens
HMQAKGILLTDGSEKDK

SEQ ID NO: 22910 - protein, 6 aa, Homo sapiens
KRQEER

SEQ ID NO: 22911 - protein, 20 aa, Homo sapiens
LEGAEEEKMEADPDGQQPEK

SEQ ID NO: 22912 - protein, 20 aa, Homo sapiens
LEGAEEEKMEADPDGQQPEK

SEQ ID NO: 22913 - protein, 15 aa, Homo sapiens
DTALETALNAKAYKR

SEQ ID NO: 22914 - protein, 15 aa, Homo sapiens
RDTALETALNAKAYK

SEQ ID NO: 22915 - protein, 15 aa, Homo sapiens
DTALETALNAKAYKR

SEQ ID NO: 22916 - protein, 5 aa, Homo sapiens
KKGEK

SEQ ID NO: 22917 - protein, 5 aa, Homo sapiens
KKGEK

SEQ ID NO: 22918 - protein, 7 aa, Homo sapiens
KVEEAAK

SEQ ID NO: 22919 - protein, 7 aa, Homo sapiens
KVEEAAK

SEQ ID NO: 22920 - protein, 9 aa, Homo sapiens
DRKASANAR

SEQ ID NO: 22921 - protein, 9 aa, Homo sapiens
DRKASANAR

SEQ ID NO: 22922 - protein, 5 aa, Homo sapiens
KTLAK

SEQ ID NO: 22923 - protein, 12 aa, Homo sapiens
EKPVDLQNFGLR

SEQ ID NO: 22924 - protein, 12 aa, Homo sapiens
EKPVDLQNFGLR

SEQ ID NO: 22925 - protein, 6 aa, Homo sapiens
EDKRNK

SEQ ID NO: 22926 - protein, 6 aa, Homo sapiens
MQVLKR

SEQ ID NO: 22927 - protein, 6 aa, Homo sapiens
MQVLKR

SEQ ID NO: 22928 - protein, 6 aa, Homo sapiens
IQKLTK

SEQ ID NO: 22929 - protein, 6 aa, Homo sapiens
GSLYKR

SEQ ID NO: 22930 - protein, 15 aa, Homo sapiens
VASAAAKAALEEFSR

SEQ ID NO: 22931 - protein, 15 aa, Homo sapiens
VASAAAKAALEEFSR

SEQ ID NO: 22932 - protein, 15 aa, Homo sapiens
VASAAAKAALEEFSR

SEQ ID NO: 22933 - protein, 15 aa, Homo sapiens
VASAAAKAALEEFSR

SEQ ID NO: 22934 - protein, 6 aa, Homo sapiens
KTKVER

SEQ ID NO: 22935 - protein, 15 aa, Homo sapiens
VASAAAKSALEEFSK

SEQ ID NO: 22936 - protein, 15 aa, Homo sapiens
VASAAAKSALEEFSK

SEQ ID NO: 22937 - protein, 9 aa, Homo sapiens
SKAAASATR

SEQ ID NO: 22938 - protein, 9 aa, Homo sapiens
SKAAASATR

SEQ ID NO: 22939 - protein, 6 aa, Homo sapiens
KTKVER

SEQ ID NO: 22940 - protein, 6 aa, Homo sapiens
KTKVER

SEQ ID NO: 22941 - protein, 7 aa, Homo sapiens
KVEEAAK

SEQ ID NO: 22942 - protein, 6 aa, Homo sapiens
KTKVER

SEQ ID NO: 22943 - protein, 6 aa, Homo sapiens
KTKVER

SEQ ID NO: 22944 - protein, 6 aa, Homo sapiens
KTKVER

SEQ ID NO: 22945 - protein, 7 aa, Homo sapiens
KVQEAAR

SEQ ID NO: 22946 - protein, 5 aa, Homo sapiens
KTLAK

SEQ ID NO: 22947 - protein, 11 aa, Homo sapiens
DPKGYVQDLLR

SEQ ID NO: 22948 - protein, 7 aa, Homo sapiens
KVQEAAR

SEQ ID NO: 22949 - protein, 7 aa, Homo sapiens
KVQEAAR

SEQ ID NO: 22950 - protein, 15 aa, Homo sapiens
VASAAAKAALEEFSR

SEQ ID NO: 22951 - protein, 6 aa, Homo sapiens
MQVLKR

SEQ ID NO: 22952 - protein, 6 aa, Homo sapiens
MQVLKR

SEQ ID NO: 22953 - protein, 6 aa, Homo sapiens
MQVLKR

SEQ ID NO: 22954 - protein, 6 aa, Homo sapiens
MQVLKR

SEQ ID NO: 22955 - protein, 6 aa, Homo sapiens
MQVLKR

SEQ ID NO: 22956 - protein, 6 aa, Homo sapiens
MQVLKR

SEQ ID NO: 22957 - protein, 6 aa, Homo sapiens
MQVLKR

SEQ ID NO: 22958 - protein, 9 aa, Homo sapiens
EKEALEQQR

SEQ ID NO: 22959 - protein, 9 aa, Homo sapiens
EKEALEQQR

SEQ ID NO: 22960 - protein, 6 aa, Homo sapiens
MQVLKR

SEQ ID NO: 22961 - protein, 6 aa, Homo sapiens
MQVLKR

SEQ ID NO: 22962 - protein, 10 aa, Homo sapiens
EKEAAEQAER

SEQ ID NO: 22963 - protein, 15 aa, Homo sapiens
VASAAAKSALEEFSK

SEQ ID NO: 22964 - protein, 5 aa, Homo sapiens
KMADK

SEQ ID NO: 22965 - protein, 10 aa, Homo sapiens
ITEKLEKQQK

SEQ ID NO: 22966 - protein, 8 aa, Homo sapiens
ITPIQKPR

SEQ ID NO: 22967 - protein, 7 aa, Homo sapiens
DFKEYHR

SEQ ID NO: 22968 - protein, 8 aa, Homo sapiens
EKLPQVTR

SEQ ID NO: 22969 - protein, 12 aa, Homo sapiens
LKLIANNTTVER

SEQ ID NO: 22970 - protein, 13 aa, Homo sapiens
LTCEEEEEKMFGR

SEQ ID NO: 22971 - protein, 8 aa, Homo sapiens
YKVLPTER

SEQ ID NO: 22972 - protein, 7 aa, Homo sapiens
KYPDLER

SEQ ID NO: 22973 - protein, 10 aa, Homo sapiens
VSYKGSPAAR

SEQ ID NO: 22974 - protein, 10 aa, Homo sapiens
VSYKGSPAAR

SEQ ID NO: 22975 - protein, 10 aa, Homo sapiens
VSYKGSPAAR

SEQ ID NO: 22976 - protein, 6 aa, Homo sapiens
EQKAKR

SEQ ID NO: 22977 - protein, 6 aa, Homo sapiens
GSLYKR

SEQ ID NO: 22978 - protein, 6 aa, Homo sapiens
GSLYKR

SEQ ID NO: 22979 - protein, 6 aa, Homo sapiens
EQKAKR

SEQ ID NO: 22980 - protein, 6 aa, Homo sapiens
GSLYKR

SEQ ID NO: 22981 - protein, 6 aa, Homo sapiens
EQKAKR

SEQ ID NO: 22982 - protein, 6 aa, Homo sapiens
EQKAKR

SEQ ID NO: 22983 - protein, 6 aa, Homo sapiens
EQKAKR

SEQ ID NO: 22984 - protein, 6 aa, Homo sapiens
EQKAKR

SEQ ID NO: 22985 - protein, 7 aa, Homo sapiens
TDIYSKK

SEQ ID NO: 22986 - protein, 15 aa, Homo sapiens
VASAAAKAALEEFSR

SEQ ID NO: 22987 - protein, 4 aa, Homo sapiens
KVGR

SEQ ID NO: 22988 - protein, 6 aa, Homo sapiens
MQVLKR

SEQ ID NO: 22989 - protein, 6 aa, Homo sapiens
KTKVER

SEQ ID NO: 22990 - protein, 12 aa, Homo sapiens
LCGLKVEVDMEK

SEQ ID NO: 22991 - protein, 7 aa, Homo sapiens
KVEEAAK

SEQ ID NO: 22992 - protein, 7 aa, Homo sapiens
KVEEAAK

SEQ ID NO: 22993 - protein, 7 aa, Homo sapiens
KVEEAAK

SEQ ID NO: 22994 - protein, 7 aa, Homo sapiens
KVEEAAK

SEQ ID NO: 22995 - protein, 5 aa, Homo sapiens
KLEIK

SEQ ID NO: 22996 - protein, 5 aa, Homo sapiens
KLEIK

SEQ ID NO: 22997 - protein, 5 aa, Homo sapiens
KLEIK

SEQ ID NO: 22998 - protein, 5 aa, Homo sapiens
KLEIK

SEQ ID NO: 22999 - protein, 5 aa, Homo sapiens
KLEIK

SEQ ID NO: 23000 - protein, 5 aa, Homo sapiens
KLEIK

SEQ ID NO: 23001 - protein, 5 aa, Homo sapiens
KLEIK

SEQ ID NO: 23002 - protein, 5 aa, Homo sapiens
KLEIK

SEQ ID NO: 23003 - protein, 5 aa, Homo sapiens
KLEIK

SEQ ID NO: 23004 - protein, 7 aa, Homo sapiens
KVEEAAK

SEQ ID NO: 23005 - protein, 15 aa, Homo sapiens
VASAAAKSALEEFSK

SEQ ID NO: 23006 - protein, 15 aa, Homo sapiens
VASAAAKSALEEFSK

SEQ ID NO: 23007 - protein, 15 aa, Homo sapiens
VASAAAKSALEEFSK

SEQ ID NO: 23008 - protein, 11 aa, Homo sapiens
DPKGYVQDLLR

SEQ ID NO: 23009 - protein, 11 aa, Homo sapiens
DPKGYVQDLLR

SEQ ID NO: 23010 - protein, 15 aa, Homo sapiens
VASAAAKSALEEFSK

SEQ ID NO: 23011 - protein, 5 aa, Homo sapiens
IEKER

SEQ ID NO: 23012 - protein, 21 aa, Homo sapiens
LPSHWLKSKGAHTTMADALWR

SEQ ID NO: 23013 - protein, 9 aa, Homo sapiens
IKIIAPPER

SEQ ID NO: 23014 - protein, 8 aa, Homo sapiens
EKLPQVTR

SEQ ID NO: 23015 - protein, 8 aa, Homo sapiens
EKLPQVTR

SEQ ID NO: 23016 - protein, 8 aa, Homo sapiens
EKLPQVTR

SEQ ID NO: 23017 - protein, 9 aa, Homo sapiens
KEKLPQVTR

SEQ ID NO: 23018 - protein, 9 aa, Homo sapiens
KEKLPQVTR

SEQ ID NO: 23019 - protein, 8 aa, Homo sapiens
EKLPQVTR

SEQ ID NO: 23020 - protein, 9 aa, Homo sapiens
KEKLPQVTR

SEQ ID NO: 23021 - protein, 11 aa, Homo sapiens
DVHLSKEQESR

SEQ ID NO: 23022 - protein, 11 aa, Homo sapiens
DVHLSKEQESR

SEQ ID NO: 23023 - protein, 11 aa, Homo sapiens
DVHLSKEQESR

SEQ ID NO: 23024 - protein, 6 aa, Homo sapiens
KEKLPK

SEQ ID NO: 23025 - protein, 8 aa, Homo sapiens
EIEEDKLK

SEQ ID NO: 23026 - protein, 8 aa, Homo sapiens
EIEEDKLK

SEQ ID NO: 23027 - protein, 11 aa, Homo sapiens
YNVPNSAIYKR

SEQ ID NO: 23028 - protein, 6 aa, Homo sapiens
EKLYLR

SEQ ID NO: 23029 - protein, 5 aa, Homo sapiens
LKLSR

SEQ ID NO: 23030 - protein, 4 aa, Homo sapiens
KVGR

SEQ ID NO: 23031 - protein, 4 aa, Homo sapiens
KVGR

SEQ ID NO: 23032 - protein, 19 aa, Homo sapiens
EAEKSEDSSGAAGLSGLHR

SEQ ID NO: 23033 - protein, 11 aa, Homo sapiens
DVHLSKEQESR

SEQ ID NO: 23034 - protein, 11 aa, Homo sapiens
DVHLSKEQESR

SEQ ID NO: 23035 - protein, 11 aa, Homo sapiens
DVHLSKEQESR

SEQ ID NO: 23036 - protein, 11 aa, Homo sapiens
DVHLSKEQESR

SEQ ID NO: 23037 - protein, 11 aa, Homo sapiens
DVHLSKEQESR

SEQ ID NO: 23038 - protein, 11 aa, Homo sapiens
DVHLSKEQESR

SEQ ID NO: 23039 - protein, 4 aa, Homo sapiens
KNIR

SEQ ID NO: 23040 - protein, 6 aa, Homo sapiens
QKKSSR

SEQ ID NO: 23041 - protein, 14 aa, Homo sapiens
NKEKPVDLQNFGLR

SEQ ID NO: 23042 - protein, 11 aa, Homo sapiens
DVHLSKEQESR

SEQ ID NO: 23043 - protein, 7 aa, Homo sapiens
KVQEAAR

SEQ ID NO: 23044 - protein, 7 aa, Homo sapiens
KVQEAAR

SEQ ID NO: 23045 - protein, 16 aa, Homo sapiens
LNVDQKVIQAGMFDQK

SEQ ID NO: 23046 - protein, 7 aa, Homo sapiens
GKESNKK

SEQ ID NO: 23047 - protein, 9 aa, Homo sapiens
ATVELKALR

SEQ ID NO: 23048 - protein, 9 aa, Homo sapiens
ATVELKALR

SEQ ID NO: 23049 - protein, 9 aa, Homo sapiens
ATVELKALR

SEQ ID NO: 23050 - protein, 8 aa, Homo sapiens
QQKIEQER

SEQ ID NO: 23051 - protein, 5 aa, Homo sapiens
NHKYR

SEQ ID NO: 23052 - protein, 5 aa, Homo sapiens
NHKYR

SEQ ID NO: 23053 - protein, 12 aa, Homo sapiens
RALPEFFNGKNK

SEQ ID NO: 23054 - protein, 10 aa, Homo sapiens
KGLAFLDELR

SEQ ID NO: 23055 - protein, 9 aa, Homo sapiens
EGSPANWKR

SEQ ID NO: 23056 - protein, 8 aa, Homo sapiens
QCVERKCP

SEQ ID NO: 23057 - protein, 6 aa, Homo sapiens
IQKLTK

SEQ ID NO: 23058 - protein, 6 aa, Homo sapiens
IQKLTK

SEQ ID NO: 23059 - protein, 6 aa, Homo sapiens
IQKLTK

SEQ ID NO: 23060 - protein, 6 aa, Homo sapiens
GSLYKR

SEQ ID NO: 23061 - protein, 7 aa, Homo sapiens
AKDDIKR

SEQ ID NO: 23062 - protein, 21 aa, Homo sapiens
KTPQQTSASQQMLNFPDKGKE

SEQ ID NO: 23063 - protein, 14 aa, Homo sapiens
KEKPTDMQNFGLRT

SEQ ID NO: 23064 - protein, 14 aa, Homo sapiens
KEKPTDMQNFGLRT

SEQ ID NO: 23065 - protein, 14 aa, Homo sapiens
KEKPTDMQNFGLRT

SEQ ID NO: 23066 - protein, 21 aa, Homo sapiens
KTPQQTSASQQMLNFPDKGKE

SEQ ID NO: 23067 - protein, 21 aa, Homo sapiens
KTPQQTSASQQMLNFPDKGKE

SEQ ID NO: 23068 - protein, 21 aa, Homo sapiens
KTPQQTSASQQMLNFPDKGKE

SEQ ID NO: 23069 - protein, 21 aa, Homo sapiens
KTPQQTSASQQMLNFPDKGKE

SEQ ID NO: 23070 - protein, 11 aa, Homo sapiens
KSKAAASATRE

SEQ ID NO: 23071 - protein, 11 aa, Homo sapiens
KSKAAASATRE

SEQ ID NO: 23072 - protein, 11 aa, Homo sapiens
KSKAAASATRE

SEQ ID NO: 23073 - protein, 11 aa, Homo sapiens
KSKAAASATRE

SEQ ID NO: 23074 - protein, 11 aa, Homo sapiens
KSKAAASATRE

SEQ ID NO: 23075 - protein, 11 aa, Homo sapiens
KSKAAASATRE

SEQ ID NO: 23076 - protein, 11 aa, Homo sapiens
KSKAAASATRE

SEQ ID NO: 23077 - protein, 9 aa, Homo sapiens
RTDMYTKKN

SEQ ID NO: 23078 - protein, 11 aa, Homo sapiens
KSKAAASATRE

SEQ ID NO: 23079 - protein, 11 aa, Homo sapiens
KSKAAASATRE

SEQ ID NO: 23080 - protein, 11 aa, Homo sapiens
KSKAAASATRE

SEQ ID NO: 23081 - protein, 11 aa, Homo sapiens
KSKAAASATRE

SEQ ID NO: 23082 - protein, 11 aa, Homo sapiens
KSKAAASATRE

SEQ ID NO: 23083 - protein, 9 aa, Homo sapiens
RTDMYTKKN

SEQ ID NO: 23084 - protein, 12 aa, Homo sapiens
RVEGQATDEKKE

SEQ ID NO: 23085 - protein, 12 aa, Homo sapiens
RVEGQATDEKKE

SEQ ID NO: 23086 - protein, 12 aa, Homo sapiens
RVEGQATDEKKE

SEQ ID NO: 23087 - protein, 8 aa, Homo sapiens
KEPKEPRE

SEQ ID NO: 23088 - protein, 12 aa, Homo sapiens
RVEGQATDEKKE

SEQ ID NO: 23089 - protein, 12 aa, Homo sapiens
RVEGQATDEKKE

SEQ ID NO: 23090 - protein, 12 aa, Homo sapiens
RVEGQATDEKKE

SEQ ID NO: 23091 - protein, 12 aa, Homo sapiens
RVEGQATDEKKE

SEQ ID NO: 23092 - protein, 12 aa, Homo sapiens
RVEGQATDEKKE

SEQ ID NO: 23093 - protein, 12 aa, Homo sapiens
RVEGQATDEKKE

SEQ ID NO: 23094 - protein, 8 aa, Homo sapiens
KEPKEPRE

SEQ ID NO: 23095 - protein, 8 aa, Homo sapiens
KEPKEPRE

SEQ ID NO: 23096 - protein, 12 aa, Homo sapiens
RVEGQATDEKKE

SEQ ID NO: 23097 - protein, 8 aa, Homo sapiens
KEPKEPRE

SEQ ID NO: 23098 - protein, 12 aa, Homo sapiens
RVEGQATDEKKE

SEQ ID NO: 23099 - protein, 8 aa, Homo sapiens
RKTKVERD

SEQ ID NO: 23100 - protein, 19 aa, Homo sapiens
KEGQEEVLKEVVESEGERK

SEQ ID NO: 23101 - protein, 19 aa, Homo sapiens
KEGQEEVLKEVVESEGERK

SEQ ID NO: 23102 - protein, 8 aa, Homo sapiens
RKTKVERD

SEQ ID NO: 23103 - protein, 19 aa, Homo sapiens
KEGQEEVLKEVVESEGERK

SEQ ID NO: 23104 - protein, 19 aa, Homo sapiens
KEGQEEVLKEVVESEGERK

SEQ ID NO: 23105 - protein, 8 aa, Homo sapiens
RKTKVERD

SEQ ID NO: 23106 - protein, 19 aa, Homo sapiens
KEGQEEVLKEVVESEGERK

SEQ ID NO: 23107 - protein, 8 aa, Homo sapiens
RKTKVERD

SEQ ID NO: 23108 - protein, 19 aa, Homo sapiens
KEGQEEVLKEVVESEGERK

SEQ ID NO: 23109 - protein, 19 aa, Homo sapiens
KEGQEEVLKEVVESEGERK

SEQ ID NO: 23110 - protein, 8 aa, Homo sapiens
RKTKVERD

SEQ ID NO: 23111 - protein, 19 aa, Homo sapiens
KEGQEEVLKEVVESEGERK

SEQ ID NO: 23112 - protein, 19 aa, Homo sapiens
KEGQEEVLKEVVESEGERK

SEQ ID NO: 23113 - protein, 19 aa, Homo sapiens
KEGQEEVLKEVVESEGERK

SEQ ID NO: 23114 - protein, 8 aa, Homo sapiens
RKTKVERD

SEQ ID NO: 23115 - protein, 8 aa, Homo sapiens
RKTKVERD

SEQ ID NO: 23116 - protein, 19 aa, Homo sapiens
KEGQEEVLKEVVESEGERK

SEQ ID NO: 23117 - protein, 8 aa, Homo sapiens
RKTKVERD

SEQ ID NO: 23118 - protein, 19 aa, Homo sapiens
KEGQEEVLKEVVESEGERK

SEQ ID NO: 23119 - protein, 17 aa, Homo sapiens
RVASAAAKSALEEFSKM

SEQ ID NO: 23120 - protein, 17 aa, Homo sapiens
RVASAAAKSALEEFSKM

SEQ ID NO: 23121 - protein, 17 aa, Homo sapiens
RVASAAAKSALEEFSKM

SEQ ID NO: 23122 - protein, 17 aa, Homo sapiens
KMKEEVPTALVEAHVRK

SEQ ID NO: 23123 - protein, 17 aa, Homo sapiens
RVASAAAKSALEEFSKM

SEQ ID NO: 23124 - protein, 17 aa, Homo sapiens
KMKEEVPTALVEAHVRK

SEQ ID NO: 23125 - protein, 17 aa, Homo sapiens
KMKEEVPTALVEAHVRK

SEQ ID NO: 23126 - protein, 17 aa, Homo sapiens
KMKEEVPTALVEAHVRK

SEQ ID NO: 23127 - protein, 17 aa, Homo sapiens
KMKEEVPTALVEAHVRK

SEQ ID NO: 23128 - protein, 17 aa, Homo sapiens
KMKEEVPTALVEAHVRK

SEQ ID NO: 23129 - protein, 17 aa, Homo sapiens
KMKEEVPTALVEAHVRK

SEQ ID NO: 23130 - protein, 17 aa, Homo sapiens
RVASAAAKSALEEFSKM

SEQ ID NO: 23131 - protein, 17 aa, Homo sapiens
KMKEEVPTALVEAHVRK

SEQ ID NO: 23132 - protein, 17 aa, Homo sapiens
KMKEEVPTALVEAHVRK

SEQ ID NO: 23133 - protein, 17 aa, Homo sapiens
KMKEEVPTALVEAHVRK

SEQ ID NO: 23134 - protein, 17 aa, Homo sapiens
RVASAAAKSALEEFSKM

SEQ ID NO: 23135 - protein, 17 aa, Homo sapiens
RVASAAAKSALEEFSKM

SEQ ID NO: 23136 - protein, 17 aa, Homo sapiens
RVASAAAKSALEEFSKM

SEQ ID NO: 23137 - protein, 17 aa, Homo sapiens
RVASAAAKSALEEFSKM

SEQ ID NO: 23138 - protein, 17 aa, Homo sapiens
RVASAAAKSALEEFSKM

SEQ ID NO: 23139 - protein, 17 aa, Homo sapiens
RVASAAAKSALEEFSKM

SEQ ID NO: 23140 - protein, 17 aa, Homo sapiens
KMKEEVPTALVEAHVRK

SEQ ID NO: 23141 - protein, 28 aa, Homo sapiens
KTKVERDIGEGNLSTAAAAALAAAAVKA

SEQ ID NO: 23142 - protein, 17 aa, Homo sapiens
RVASAAAKSALEEFSKM

SEQ ID NO: 23143 - protein, 17 aa, Homo sapiens
RVASAAAKSALEEFSKM

SEQ ID NO: 23144 - protein, 17 aa, Homo sapiens
RVASAAAKSALEEFSKM

SEQ ID NO: 23145 - protein, 17 aa, Homo sapiens
RVASAAAKSALEEFSKM

SEQ ID NO: 23146 - protein, 17 aa, Homo sapiens
RVASAAAKSALEEFSKM

SEQ ID NO: 23147 - protein, 8 aa, Homo sapiens
RKTKVERD

SEQ ID NO: 23148 - protein, 12 aa, Homo sapiens
KAKHLAAVEERK

SEQ ID NO: 23149 - protein, 12 aa, Homo sapiens
KAKHLAAVEERK

SEQ ID NO: 23150 - protein, 38 aa, Homo sapiens; identical to SEQ ID NO: 6132

SEQ ID NO: 23151 - protein, 38 aa, Homo sapiens; identical to SEQ ID NO: 6132

SEQ ID NO: 23152 - protein, 38 aa, Homo sapiens; identical to SEQ ID NO: 6132

SEQ ID NO: 23153 - protein, 9 aa, Homo sapiens
RKVEEAAKV

SEQ ID NO: 23154 - protein, 9 aa, Homo sapiens
RKVEEAAKV

SEQ ID NO: 23155 - protein, 9 aa, Homo sapiens
RKVEEAAKV

SEQ ID NO: 23156 - protein, 9 aa, Homo sapiens
RKVEEAAKV

SEQ ID NO: 23157 - protein, 8 aa, Homo sapiens
RKTKVERD

SEQ ID NO: 23158 - protein, 12 aa, Homo sapiens
KAKHLAAVEERK

SEQ ID NO: 23159 - protein, 11 aa, Homo sapiens
KSKAAASATRE

SEQ ID NO: 23160 - protein, 11 aa, Homo sapiens
KSKAAASATRE

SEQ ID NO: 23161 - protein, 17 aa, Homo sapiens
KMKEEVPTALVEAHVRK

SEQ ID NO: 23162 - protein, 17 aa, Homo sapiens
KMKEEVPTALVEAHVRK

SEQ ID NO: 23163 - protein, 15 aa, Homo sapiens
REGGGAIEEEAKEKT

SEQ ID NO: 23164 - protein, 15 aa, Homo sapiens
REGGGAIEEEAKEKT

SEQ ID NO: 23165 - protein, 15 aa, Homo sapiens
REGGGAIEEEAKEKT

SEQ ID NO: 23166 - protein, 15 aa, Homo sapiens
REGGGAIEEEAKEKT

SEQ ID NO: 23167 - protein, 15 aa, Homo sapiens
REGGGAIEEEAKEKT

SEQ ID NO: 23168 - protein, 13 aa, Homo sapiens
KTSEAPKKDEEKG

SEQ ID NO: 23169 - protein, 15 aa, Homo sapiens
REGGGAIEEEAKEKT

SEQ ID NO: 23170 - protein, 13 aa, Homo sapiens
KTSEAPKKDEEKG

SEQ ID NO: 23171 - protein, 9 aa, Homo sapiens
KKDEEKGKE

SEQ ID NO: 23172 - protein, 15 aa, Homo sapiens
REGGGAIEEEAKEKT

SEQ ID NO: 23173 - protein, 7 aa, Homo sapiens
KTKVERD

SEQ ID NO: 23174 - protein, 7 aa, Homo sapiens
KTKVERD

SEQ ID NO: 23175 - protein, 13 aa, Homo sapiens
RKVEEAAKVTGKA

SEQ ID NO: 23176 - protein, 13 aa, Homo sapiens
RKVEEAAKVTGKA

SEQ ID NO: 23177 - protein, 8 aa, Homo sapiens
RKTKVERD

SEQ ID NO: 23178 - protein, 8 aa, Homo sapiens
KKNVPSKS

SEQ ID NO: 23179 - protein, 11 aa, Homo sapiens
KSKAAASATRE

SEQ ID NO: 23180 - protein, 11 aa, Homo sapiens
KSKAAASATRE

SEQ ID NO: 23181 - protein, 11 aa, Homo sapiens
KSKAAASATRE

SEQ ID NO: 23182 - protein, 11 aa, Homo sapiens
KSKAAASATRE

SEQ ID NO: 23183 - protein, 11 aa, Homo sapiens
KSKAAASATRE

SEQ ID NO: 23184 - protein, 11 aa, Homo sapiens
KSKAAASATRE

SEQ ID NO: 23185 - protein, 11 aa, Homo sapiens
KSKAAASATRE

SEQ ID NO: 23186 - protein, 8 aa, Homo sapiens
KKNVPSKS

SEQ ID NO: 23187 - protein, 9 aa, Homo sapiens
RTDMYTKKN

SEQ ID NO: 23188 - protein, 12 aa, Homo sapiens
KAKHLAAVEERK

SEQ ID NO: 23189 - protein, 17 aa, Homo sapiens
KMKEEVPTALVEAHVRK

SEQ ID NO: 23190 - protein, 12 aa, Homo sapiens
KAKHLAAVEERK

SEQ ID NO: 23191 - protein, 17 aa, Homo sapiens
KMKEEVPTALVEAHVRK

SEQ ID NO: 23192 - protein, 12 aa, Homo sapiens
KAKHLAAVEERK

SEQ ID NO: 23193 - protein, 17 aa, Homo sapiens
KMKEEVPTALVEAHVRK

SEQ ID NO: 23194 - protein, 12 aa, Homo sapiens
KAKHLAAVEERK

SEQ ID NO: 23195 - protein, 12 aa, Homo sapiens
KAKHLAAVEERK

SEQ ID NO: 23196 - protein, 17 aa, Homo sapiens
KMKEEVPTALVEAHVRK

SEQ ID NO: 23197 - protein, 12 aa, Homo sapiens
KAKHLAAVEERK

SEQ ID NO: 23198 - protein, 12 aa, Homo sapiens
KAKHLAAVEERK

SEQ ID NO: 23199 - protein, 17 aa, Homo sapiens
KMKEEVPTALVEAHVRK

SEQ ID NO: 23200 - protein, 12 aa, Homo sapiens
KAKHLAAVEERK

SEQ ID NO: 23201 - protein, 12 aa, Homo sapiens
KAKHLAAVEERK

SEQ ID NO: 23202 - protein, 17 aa, Homo sapiens
KMKEEVPTALVEAHVRK

SEQ ID NO: 23203 - protein, 17 aa, Homo sapiens
KMKEEVPTALVEAHVRK

SEQ ID NO: 23204 - protein, 7 aa, Homo sapiens
KTKVERD

SEQ ID NO: 23205 - protein, 9 aa, Homo sapiens
RKVEEAAKV

SEQ ID NO: 23206 - protein, 17 aa, Homo sapiens
KMKEEVPTALVEAHVRK

SEQ ID NO: 23207 - protein, 17 aa, Homo sapiens
KMKEEVPTALVEAHVRK

SEQ ID NO: 23208 - protein, 17 aa, Homo sapiens
KMKEEVPTALVEAHVRK

SEQ ID NO: 23209 - protein, 13 aa, Homo sapiens
RKVEEAAKVTGKA

SEQ ID NO: 23210 - protein, 13 aa, Homo sapiens
RKVEEAAKVTGKA

SEQ ID NO: 23211 - protein, 13 aa, Homo sapiens
RKVEEAAKVTGKA

SEQ ID NO: 23212 - protein, 17 aa, Homo sapiens
KMKEEVPTALVEAHVRK

SEQ ID NO: 23213 - protein, 9 aa, Homo sapiens
RKVEEAAKV

SEQ ID NO: 23214 - protein, 17 aa, Homo sapiens
KMKEEVPTALVEAHVRK

SEQ ID NO: 23215 - protein, 13 aa, Homo sapiens
RKVEEAAKVTGKA

SEQ ID NO: 23216 - protein, 17 aa, Homo sapiens
KMKEEVPTALVEAHVRK

SEQ ID NO: 23217 - protein, 13 aa, Homo sapiens
RKVEEAAKVTGKA

SEQ ID NO: 23218 - protein, 18 aa, Homo sapiens
KSDGDPIVDPEKEKEPKE

SEQ ID NO: 23219 - protein, 18 aa, Homo sapiens
KSDGDPIVDPEKEKEPKE

SEQ ID NO: 23220 - protein, 15 aa, Homo sapiens
KSDGDPIVDPEKEKE

SEQ ID NO: 23221 - protein, 19 aa, Homo sapiens
KESEKSDGDPIVDPEKEKE

SEQ ID NO: 23222 - protein, 19 aa, Homo sapiens
KESEKSDGDPIVDPEKEKE

SEQ ID NO: 23223 - protein, 15 aa, Homo sapiens
KSDGDPIVDPEKEKE

SEQ ID NO: 23224 - protein, 15 aa, Homo sapiens
KSDGDPIVDPEKEKE

SEQ ID NO: 23225 - protein, 22 aa, Homo sapiens
KEPKEGQEEVLKEVVESEGERK

SEQ ID NO: 23226 - protein, 22 aa, Homo sapiens
KEPKEGQEEVLKEVVESEGERK

SEQ ID NO: 23227 - protein, 22 aa, Homo sapiens
KEPKEGQEEVLKEVVESEGERK

SEQ ID NO: 23228 - protein, 19 aa, Homo sapiens
KESEKSDGDPIVDPEKEKE

SEQ ID NO: 23229 - protein, 15 aa, Homo sapiens
KSDGDPIVDPEKEKE

SEQ ID NO: 23230 - protein, 22 aa, Homo sapiens
KEPKEGQEEVLKEVVESEGERK

SEQ ID NO: 23231 - protein, 15 aa, Homo sapiens
KSDGDPIVDPEKEKE

SEQ ID NO: 23232 - protein, 22 aa, Homo sapiens
KEPKEGQEEVLKEVVESEGERK

SEQ ID NO: 23233 - protein, 22 aa, Homo sapiens
KEPKEGQEEVLKEVVESEGERK

SEQ ID NO: 23234 - protein, 22 aa, Homo sapiens
KEPKEGQEEVLKEVVESEGERK

SEQ ID NO: 23235 - protein, 32 aa, Homo sapiens; identical to SEQ ID NO: 5995

SEQ ID NO: 23236 - protein, 32 aa, Homo sapiens; identical to SEQ ID NO: 5995

SEQ ID NO: 23237 - protein, 32 aa, Homo sapiens; identical to SEQ ID NO: 5995

SEQ ID NO: 23238 - protein, 16 aa, Homo sapiens
KTVNTKKDSESAPVKG

SEQ ID NO: 23239 - protein, 16 aa, Homo sapiens
KTVNTKKDSESAPVKG

SEQ ID NO: 23240 - protein, 13 aa, Homo sapiens
KTSEAPKKDEEKG

SEQ ID NO: 23241 - protein, 13 aa, Homo sapiens
KTSEAPKKDEEKG

SEQ ID NO: 23242 - protein, 13 aa, Homo sapiens
KTSEAPKKDEEKG

SEQ ID NO: 23243 - protein, 13 aa, Homo sapiens
KTSEAPKKDEEKG

SEQ ID NO: 23244 - protein, 21 aa, Homo sapiens
REGGGAIEEEAKEKTSEAPKK

SEQ ID NO: 23245 - protein, 10 aa, Homo sapiens
KEKTSEAPKK

SEQ ID NO: 23246 - protein, 10 aa, Homo sapiens
KEKTSEAPKK

SEQ ID NO: 23247 - protein, 10 aa, Homo sapiens
KEKTSEAPKK

SEQ ID NO: 23248 - protein, 10 aa, Homo sapiens
KEKTSEAPKK

SEQ ID NO: 23249 - protein, 10 aa, Homo sapiens
KEKTSEAPKK

SEQ ID NO: 23250 - protein, 10 aa, Homo sapiens
KEKTSEAPKK

SEQ ID NO: 23251 - protein, 11 aa, Homo sapiens
KKGPSTPYTKS

SEQ ID NO: 23252 - protein, 12 aa, Homo sapiens
KAKHLAAVEERK

SEQ ID NO: 23253 - protein, 12 aa, Homo sapiens
KAKHLAAVEERK

SEQ ID NO: 23254 - protein, 9 aa, Homo sapiens
RKVEEAAKV

SEQ ID NO: 23255 - protein, 15 aa, Homo sapiens
KLLHSGMKILSQERI

SEQ ID NO: 23256 - protein, 20 aa, Homo sapiens
RDRVENEAEKDLQCHAPVRL

SEQ ID NO: 23257 - protein, 9 aa, Homo sapiens
RKLIDQKKD

SEQ ID NO: 23258 - protein, 9 aa, Homo sapiens
RKLIDQKKD

SEQ ID NO: 23259 - protein, 9 aa, Homo sapiens
RKLIDQKKD

SEQ ID NO: 23260 - protein, 7 aa, Homo sapiens
RNHKYRS

SEQ ID NO: 23261 - protein, 8 aa, Homo sapiens
RKPVDFKK

SEQ ID NO: 23262 - protein, 8 aa, Homo sapiens
RKPVDFKK

SEQ ID NO: 23263 - protein, 8 aa, Homo sapiens
RILPKLRA

SEQ ID NO: 23264 - protein, 7 aa, Homo sapiens
RNHKYRS

SEQ ID NO: 23265 - protein, 10 aa, Homo sapiens
KYKLNVDQKV

SEQ ID NO: 23266 - protein, 18 aa, Homo sapiens
KVIQAGMFDQKSSSHERR

SEQ ID NO: 23267 - protein, 18 aa, Homo sapiens
KVIQAGMFDQKSSSHERR

SEQ ID NO: 23268 - protein, 10 aa, Homo sapiens
KYKLNVDQKV

SEQ ID NO: 23269 - protein, 10 aa, Homo sapiens
KYKLNVDQKV

SEQ ID NO: 23270 - protein, 10 aa, Homo sapiens
KYKLNVDQKV

SEQ ID NO: 23271 - protein, 10 aa, Homo sapiens
KYKLNVDQKV

SEQ ID NO: 23272 - protein, 6 aa, Homo sapiens
KIKERI

SEQ ID NO: 23273 - protein, 8 aa, Homo sapiens
RLHKVLRP

SEQ ID NO: 23274 - protein, 18 aa, Homo sapiens
RGQPLPETLQLAVQGKRT

SEQ ID NO: 23275 - protein, 18 aa, Homo sapiens
RGQPLPETLQLAVQGKRT

SEQ ID NO: 23276 - protein, 15 aa, Homo sapiens
RLTCEEEEEKIFGRG

SEQ ID NO: 23277 - protein, 15 aa, Homo sapiens
RLTCEEEEEKIFGRG

SEQ ID NO: 23278 - protein, 18 aa, Homo sapiens
RLCTVNSVEEKILAAAKY

SEQ ID NO: 23279 - protein, 18 aa, Homo sapiens
RLCTVNSVEEKILAAAKY

SEQ ID NO: 23280 - protein, 8 aa, Homo sapiens
RGSLYKRY

SEQ ID NO: 23281 - protein, 8 aa, Homo sapiens
RGSLYKRY

SEQ ID NO: 23282 - protein, 8 aa, Homo sapiens
RGSLYKRY

SEQ ID NO: 23283 - protein, 17 aa, Homo sapiens
KYKAVSISTEPPTYLRE

SEQ ID NO: 23284 - protein, 11 aa, Homo sapiens
KIVASSHGKKT

SEQ ID NO: 23285 - protein, 8 aa, Homo sapiens
RKDGPKRS

SEQ ID NO: 23286 - protein, 7 aa, Homo sapiens
RKDGPKR

SEQ ID NO: 23287 - protein, 7 aa, Homo sapiens
RKDGPKR

SEQ ID NO: 23288 - protein, 11 aa, Homo sapiens
KSKDKAATPRK

SEQ ID NO: 23289 - protein, 11 aa, Homo sapiens
KSKDKAATPRK

SEQ ID NO: 23290 - protein, 11 aa, Homo sapiens
KSKDKAATPRK

SEQ ID NO: 23291 - protein, 8 aa, Homo sapiens
RKDGPKRS

SEQ ID NO: 23292 - protein, 9 aa, Homo sapiens
KDKAATPRK

SEQ ID NO: 23293 - protein, 7 aa, Homo sapiens
RKDGPKR

SEQ ID NO: 23294 - protein, 9 aa, Homo sapiens
KDKAATPRK

SEQ ID NO: 23295 - protein, 8 aa, Homo sapiens
RKDGPKRS

SEQ ID NO: 23296 - protein, 9 aa, Homo sapiens
KDKAATPRK

SEQ ID NO: 23297 - protein, 8 aa, Homo sapiens
RKDGPKRS

SEQ ID NO: 23298 - protein, 11 aa, Homo sapiens
KSKDKAATPRK

SEQ ID NO: 23299 - protein, 11 aa, Homo sapiens
KSKDKAATPRK

SEQ ID NO: 23300 - protein, 9 aa, Homo sapiens
KDKAATPRK

SEQ ID NO: 23301 - protein, 11 aa, Homo sapiens
KSKDKAATPRK

SEQ ID NO: 23302 - protein, 7 aa, Homo sapiens
RKDGPKR

SEQ ID NO: 23303 - protein, 11 aa, Homo sapiens
KSKDKAATPRK

SEQ ID NO: 23304 - protein, 11 aa, Homo sapiens
KSKDKAATPRK

SEQ ID NO: 23305 - protein, 11 aa, Homo sapiens
KSKDKAATPRK

SEQ ID NO: 23306 - protein, 11 aa, Homo sapiens
KSKDKAATPRK

SEQ ID NO: 23307 - protein, 13 aa, Homo sapiens
KVEASKVPEYIKK

SEQ ID NO: 23308 - protein, 7 aa, Homo sapiens
KKAAKKA

SEQ ID NO: 23309 - protein, 13 aa, Homo sapiens
KVEASKVPEYIKK

SEQ ID NO: 23310 - protein, 13 aa, Homo sapiens
KKAAEFNSNLNRE

SEQ ID NO: 23311 - protein, 14 aa, Homo sapiens
KVEASKVPEYIKKA

SEQ ID NO: 23312 - protein, 14 aa, Homo sapiens
KVEASKVPEYIKKA

SEQ ID NO: 23313 - protein, 13 aa, Homo sapiens
KKAAEFNSNLNRE

SEQ ID NO: 23314 - protein, 8 aa, Homo sapiens
RKDGPKRS

SEQ ID NO: 23315 - protein, 14 aa, Homo sapiens
KRSVLSKSVPGYKP

SEQ ID NO: 23316 - protein, 15 aa, Homo sapiens
RSVLSKSVPGYKPKV

SEQ ID NO: 23317 - protein, 12 aa, Homo sapiens
KVPEYIKKAAKK

SEQ ID NO: 23318 - protein, 12 aa, Homo sapiens
KVPEYIKKAAKK

SEQ ID NO: 23319 - protein, 10 aa, Homo sapiens
RKYPDLERRD

SEQ ID NO: 23320 - protein, 9 aa, Homo sapiens
RKYPDLERR

SEQ ID NO: 23321 - protein, 17 aa, Homo sapiens
RSDEVIDLMIKEYPAKH

SEQ ID NO: 23322 - protein, 17 aa, Homo sapiens
RSDEVIDLMIKEYPAKH

SEQ ID NO: 23323 - protein, 17 aa, Homo sapiens
RSDEVIDLMIKEYPAKH

SEQ ID NO: 23324 - protein, 9 aa, Homo sapiens
RKYPDLERR

SEQ ID NO: 23325 - protein, 9 aa, Homo sapiens
RKYPDLERR

SEQ ID NO: 23326 - protein, 17 aa, Homo sapiens
RSDEVIDLMIKEYPAKH

SEQ ID NO: 23327 - protein, 17 aa, Homo sapiens
RSDEVIDLMIKEYPAKH

SEQ ID NO: 23328 - protein, 9 aa, Homo sapiens
RKYPDLERR

SEQ ID NO: 23329 - protein, 9 aa, Homo sapiens
RKYPDLERR

SEQ ID NO: 23330 - protein, 20 aa, Homo sapiens
KEYPAKHAEYSVILQEKERQ

SEQ ID NO: 23331 - protein, 10 aa, Homo sapiens
KRKYPDLERR

SEQ ID NO: 23332 - protein, 18 aa, Homo sapiens
KEYPAKHAEYSVILQEKE

SEQ ID NO: 23333 - protein, 18 aa, Homo sapiens
KEYPAKHAEYSVILQEKE

SEQ ID NO: 23334 - protein, 9 aa, Homo sapiens
RKYPDLERR

SEQ ID NO: 23335 - protein, 18 aa, Homo sapiens
KEYPAKHAEYSVILQEKE

SEQ ID NO: 23336 - protein, 18 aa, Homo sapiens
KEYPAKHAEYSVILQEKE

SEQ ID NO: 23337 - protein, 18 aa, Homo sapiens
KEYPAKHAEYSVILQEKE

SEQ ID NO: 23338 - protein, 9 aa, Homo sapiens
RKYPDLERR

SEQ ID NO: 23339 - protein, 18 aa, Homo sapiens
KEYPAKHAEYSVILQEKE

SEQ ID NO: 23340 - protein, 18 aa, Homo sapiens
KEYPAKHAEYSVILQEKE

SEQ ID NO: 23341 - protein, 20 aa, Homo sapiens
KEYPAKHAEYSVILQEKERQ

SEQ ID NO: 23342 - protein, 9 aa, Homo sapiens
RKYPDLERR

SEQ ID NO: 23343 - protein, 18 aa, Homo sapiens
KEYPAKHAEYSVILQEKE

SEQ ID NO: 23344 - protein, 18 aa, Homo sapiens
KEYPAKHAEYSVILQEKE

SEQ ID NO: 23345 - protein, 18 aa, Homo sapiens
KEYPAKHAEYSVILQEKE

SEQ ID NO: 23346 - protein, 9 aa, Homo sapiens
RKYPDLERR

SEQ ID NO: 23347 - protein, 10 aa, Homo sapiens
RKYPDLERRD

SEQ ID NO: 23348 - protein, 10 aa, Homo sapiens
RKYPDLERRD

SEQ ID NO: 23349 - protein, 10 aa, Homo sapiens
KYKVLPTERT

SEQ ID NO: 23350 - protein, 23 aa, Homo sapiens
RTKVSSYPVALIPGQFQEYYKRY

SEQ ID NO: 23351 - protein, 23 aa, Homo sapiens
RTKVSSYPVALIPGQFQEYYKRY

SEQ ID NO: 23352 - protein, 22 aa, Homo sapiens
RTKVSSYPVALIPGQFQEYYKR

SEQ ID NO: 23353 - protein, 13 aa, Homo sapiens
RSVLSKSVPGYKP

SEQ ID NO: 23354 - protein, 6 aa, Homo sapiens
RKVGRR

SEQ ID NO: 23355 - protein, 17 aa, Homo sapiens
RKFLESTDSFNNELKRL

SEQ ID NO: 23356 - protein, 17 aa, Homo sapiens
RKFLESTDSFNNELKRL

SEQ ID NO: 23357 - protein, 17 aa, Homo sapiens
RKFLESTDSFNNELKRL

SEQ ID NO: 23358 - protein, 17 aa, Homo sapiens
RKFLESTDSFNNELKRL

SEQ ID NO: 23359 - protein, 17 aa, Homo sapiens
RKFLESTDSFNNELKRL

SEQ ID NO: 23360 - protein, 14 aa, Homo sapiens
RLCGLKVEVDMEKI

SEQ ID NO: 23361 - protein, 14 aa, Homo sapiens
RLCGLKVEVDMEKI

SEQ ID NO: 23362 - protein, 14 aa, Homo sapiens
RLCGLKVEVDMEKI

SEQ ID NO: 23363 - protein, 14 aa, Homo sapiens
RLCGLKVEVDMEKI

SEQ ID NO: 23364 - protein, 12 aa, Homo sapiens
REKEAAEQAERS

SEQ ID NO: 23365 - protein, 16 aa, Homo sapiens
RVTASSGITIPKPPKP

SEQ ID NO: 23366 - protein, 16 aa, Homo sapiens
RVTASSGITIPKPPKP

SEQ ID NO: 23367 - protein, 16 aa, Homo sapiens
RVTASSGITIPKPPKP

SEQ ID NO: 23368 - protein, 16 aa, Homo sapiens
RVTASSGITIPKPPKP

SEQ ID NO: 23369 - protein, 16 aa, Homo sapiens
RVTASSGITIPKPPKP

SEQ ID NO: 23370 - protein, 16 aa, Homo sapiens
RVTASSGITIPKPPKP

SEQ ID NO: 23371 - protein, 16 aa, Homo sapiens
RVTASSGITIPKPPKP

SEQ ID NO: 23372 - protein, 16 aa, Homo sapiens
RVTASSGITIPKPPKP

SEQ ID NO: 23373 - protein, 16 aa, Homo sapiens
RVTASSGITIPKPPKP

SEQ ID NO: 23374 - protein, 16 aa, Homo sapiens
RVTASSGITIPKPPKP

SEQ ID NO: 23375 - protein, 16 aa, Homo sapiens
RVTASSGITIPKPPKP

SEQ ID NO: 23376 - protein, 12 aa, Homo sapiens
KAKHLAAVEERK

SEQ ID NO: 23377 - protein, 12 aa, Homo sapiens
KAKHLAAVEERK

SEQ ID NO: 23378 - protein, 36 aa, Homo sapiens; identical to SEQ ID NO: 6516

SEQ ID NO: 23379 - protein, 18 aa, Homo sapiens
RVREEVPLELVEAHVKKV

SEQ ID NO: 23380 - protein, 18 aa, Homo sapiens
RVREEVPLELVEAHVKKV

SEQ ID NO: 23381 - protein, 17 aa, Homo sapiens
RVASAAAKAALEEFSRV

SEQ ID NO: 23382 - protein, 12 aa, Homo sapiens
KAKHLAAVEERK

SEQ ID NO: 23383 - protein, 12 aa, Homo sapiens
KAKHLAAVEERK

SEQ ID NO: 23384 - protein, 17 aa, Homo sapiens
RVASAAAKAALEEFSRV

SEQ ID NO: 23385 - protein, 17 aa, Homo sapiens
RVASAAAKAALEEFSRV

SEQ ID NO: 23386 - protein, 17 aa, Homo sapiens
RVASAAAKAALEEFSRV

SEQ ID NO: 23387 - protein, 9 aa, Homo sapiens
RKASANARK

SEQ ID NO: 23388 - protein, 16 aa, Homo sapiens
RISTKNEEPVRSPERR

SEQ ID NO: 23389 - protein, 16 aa, Homo sapiens
RISTKNEEPVRSPERR

SEQ ID NO: 23390 - protein, 12 aa, Homo sapiens
RISTKNEEPVRS

SEQ ID NO: 23391 - protein, 11 aa, Homo sapiens
RDRKASANARK

SEQ ID NO: 23392 - protein, 10 aa, Homo sapiens
KSKGASAGRE

SEQ ID NO: 23393 - protein, 11 aa, Homo sapiens
KKGQASLYGKR

SEQ ID NO: 23394 - protein, 7 aa, Homo sapiens
RKKSGKK

SEQ ID NO: 23395 - protein, 11 aa, Homo sapiens
KKGQASLYGKR

SEQ ID NO: 23396 - protein, 7 aa, Homo sapiens
RKKSGKK

SEQ ID NO: 23397 - protein, 11 aa, Homo sapiens
KKGQASLYGKR

SEQ ID NO: 23398 - protein, 11 aa, Homo sapiens
KKGQASLYGKR

SEQ ID NO: 23399 - protein, 11 aa, Homo sapiens
KKGQASLYGKR

SEQ ID NO: 23400 - protein, 14 aa, Homo sapiens
KEKPVDLQNFGLRT

SEQ ID NO: 23401 - protein, 14 aa, Homo sapiens
KEKPVDLQNFGLRT

SEQ ID NO: 23402 - protein, 14 aa, Homo sapiens
KEKPVDLQNFGLRT

SEQ ID NO: 23403 - protein, 20 aa, Homo sapiens
RSPQVPAAQQMLNFPEKNKE

SEQ ID NO: 23404 - protein, 14 aa, Homo sapiens
KEKPVDLQNFGLRT

SEQ ID NO: 23405 - protein, 14 aa, Homo sapiens
KEKPVDLQNFGLRT

SEQ ID NO: 23406 - protein, 20 aa, Homo sapiens
RSPQVPAAQQMLNFPEKNKE

SEQ ID NO: 23407 - protein, 20 aa, Homo sapiens
RSPQVPAAQQMLNFPEKNKE

SEQ ID NO: 23408 - protein, 14 aa, Homo sapiens
KEKPVDLQNFGLRT

SEQ ID NO: 23409 - protein, 20 aa, Homo sapiens
RSPQVPAAQQMLNFPEKNKE

SEQ ID NO: 23410 - protein, 20 aa, Homo sapiens
RSPQVPAAQQMLNFPEKNKE

SEQ ID NO: 23411 - protein, 7 aa, Homo sapiens
RKKSGKK

SEQ ID NO: 23412 - protein, 7 aa, Homo sapiens
RKKSGKK

SEQ ID NO: 23413 - protein, 12 aa, Homo sapiens
KKGQASLYGKRR

SEQ ID NO: 23414 - protein, 12 aa, Homo sapiens
KKGQASLYGKRR

SEQ ID NO: 23415 - protein, 12 aa, Homo sapiens
KKGQASLYGKRR

SEQ ID NO: 23416 - protein, 14 aa, Homo sapiens
RRALPEFFNGKNKS

SEQ ID NO: 23417 - protein, 13 aa, Homo sapiens
KSKTPEIYLAYRN

SEQ ID NO: 23418 - protein, 14 aa, Homo sapiens
KEKPVDLQNFGLRT

SEQ ID NO: 23419 - protein, 36 aa, Homo sapiens; identical to SEQ ID NO: 6516

SEQ ID NO: 23420 - protein, 36 aa, Homo sapiens; identical to SEQ ID NO: 6516

SEQ ID NO: 23421 - protein, 9 aa, Homo sapiens
KKVQEAARA

SEQ ID NO: 23422 - protein, 9 aa, Homo sapiens
KKVQEAARA

SEQ ID NO: 23423 - protein, 9 aa, Homo sapiens
KKVQEAARA

SEQ ID NO: 23424 - protein, 9 aa, Homo sapiens
KKVQEAARA

SEQ ID NO: 23425 - protein, 9 aa, Homo sapiens
RTDIYSKKT

SEQ ID NO: 23426 - protein, 9 aa, Homo sapiens
RTDIYSKKT

SEQ ID NO: 23427 - protein, 9 aa, Homo sapiens
RTDIYSKKT

SEQ ID NO: 23428 - protein, 10 aa, Homo sapiens
KSKGASAGRE

SEQ ID NO: 23429 - protein, 9 aa, Homo sapiens
RTDIYSKKT

SEQ ID NO: 23430 - protein, 10 aa, Homo sapiens
KSKGASAGRE

SEQ ID NO: 23431 - protein, 10 aa, Homo sapiens
KSKGASAGRE

SEQ ID NO: 23432 - protein, 18 aa, Homo sapiens
RMQKEITALAPSTMKIKI

SEQ ID NO: 23433 - protein, 15 aa, Homo sapiens
KEITALAPSTMKIKI

SEQ ID NO: 23434 - protein, 15 aa, Homo sapiens
KEITALAPSTMKIKI

SEQ ID NO: 23435 - protein, 15 aa, Homo sapiens
KEITALAPSTMKIKI

SEQ ID NO: 23436 - protein, 18 aa, Homo sapiens
RMQKEITALAPSTMKIKI

SEQ ID NO: 23437 - protein, 15 aa, Homo sapiens
KEITALAPSTMKIKI

SEQ ID NO: 23438 - protein, 24 aa, Homo sapiens
RKDLYANTVLSGGTTMYPGIADRM

SEQ ID NO: 23439 - protein, 24 aa, Homo sapiens
RKDLYANTVLSGGTTMYPGIADRM

SEQ ID NO: 23440 - protein, 15 aa, Homo sapiens
KEITALAPSTMKIKI

SEQ ID NO: 23441 - protein, 15 aa, Homo sapiens
KEITALAPSTMKIKI

SEQ ID NO: 23442 - protein, 22 aa, Homo sapiens
KEITALAPSTMKIKIIAPPERK

SEQ ID NO: 23443 - protein, 15 aa, Homo sapiens
KEITALAPSTMKIKI

SEQ ID NO: 23444 - protein, 12 aa, Homo sapiens
KIKIIAPPERKY

SEQ ID NO: 23445 - protein, 11 aa, Homo sapiens
KIKIIAPPERK

SEQ ID NO: 23446 - protein, 11 aa, Homo sapiens
KIKIIAPPERK

SEQ ID NO: 23447 - protein, 11 aa, Homo sapiens
KIKIIAPPERK

SEQ ID NO: 23448 - protein, 12 aa, Homo sapiens
KIKIIAPPERKY

SEQ ID NO: 23449 - protein, 12 aa, Homo sapiens
KIKIIAPPERKY

SEQ ID NO: 23450 - protein, 12 aa, Homo sapiens
KIKIIAPPERKY

SEQ ID NO: 23451 - protein, 11 aa, Homo sapiens
KIKIIAPPERK

SEQ ID NO: 23452 - protein, 11 aa, Homo sapiens
KIKIIAPPERK

SEQ ID NO: 23453 - protein, 12 aa, Homo sapiens
KIKIIAPPERKY

SEQ ID NO: 23454 - protein, 11 aa, Homo sapiens
KIKIIAPPERK

SEQ ID NO: 23455 - protein, 11 aa, Homo sapiens
KIKIIAPPERK

SEQ ID NO: 23456 - protein, 11 aa, Homo sapiens
KIKIIAPPERK

SEQ ID NO: 23457 - protein, 11 aa, Homo sapiens
KIKIIAPPERK

SEQ ID NO: 23458 - protein, 15 aa, Homo sapiens
RDLTDYLMKILTERG

SEQ ID NO: 23459 - protein, 4 aa, Homo sapiens
RKCF

SEQ ID NO: 23460 - protein, 4 aa, Homo sapiens
RKCF

SEQ ID NO: 23461 - protein, 4 aa, Homo sapiens
RKCF

SEQ ID NO: 23462 - protein, 4 aa, Homo sapiens
RKCF

SEQ ID NO: 23463 - protein, 4 aa, Homo sapiens
RKCF

SEQ ID NO: 23464 - protein, 23 aa, Homo sapiens
RVAPEEHPVLLTEAPLNPKANRE

SEQ ID NO: 23465 - protein, 11 aa, Homo sapiens
KIKIIAPPERK

SEQ ID NO: 23466 - protein, 22 aa, Homo sapiens
KEITALAPSTMKIKIIAPPERK

SEQ ID NO: 23467 - protein, 13 aa, Homo sapiens
KEPIDLKTIAQRI

SEQ ID NO: 23468 - protein, 12 aa, Homo sapiens
RAAKVAEQQERE

SEQ ID NO: 23469 - protein, 15 aa, Homo sapiens
RNLETAKKAEYEERA

SEQ ID NO: 23470 - protein, 15 aa, Homo sapiens
RNLETAKKAEYEERA

SEQ ID NO: 23471 - protein, 15 aa, Homo sapiens
RNLETAKKAEYEERA

SEQ ID NO: 23472 - protein, 12 aa, Homo sapiens
RAAKVAEQQERE

SEQ ID NO: 23473 - protein, 15 aa, Homo sapiens
RNLETAKKAEYEERA

SEQ ID NO: 23474 - protein, 14 aa, Homo sapiens
RAAKVAEQQERERA

SEQ ID NO: 23475 - protein, 14 aa, Homo sapiens
RAAKVAEQQERERA

SEQ ID NO: 23476 - protein, 20 aa, Homo sapiens
RNNQGQLIAEPFYHLPSKKK

SEQ ID NO: 23477 - protein, 20 aa, Homo sapiens
RNNQGQLIAEPFYHLPSKKK

SEQ ID NO: 23478 - protein, 20 aa, Homo sapiens
RNNQGQLIAEPFYHLPSKKK

SEQ ID NO: 23479 - protein, 17 aa, Homo sapiens
RKINMSGYILFSSEMRA

SEQ ID NO: 23480 - protein, 17 aa, Homo sapiens
RKINMSGYILFSSEMRA

SEQ ID NO: 23481 - protein, 17 aa, Homo sapiens
RKINMSGYILFSSEMRA

SEQ ID NO: 23482 - protein, 17 aa, Homo sapiens
RKINMSGYILFSSEMRA

SEQ ID NO: 23483 - protein, 11 aa, Homo sapiens
KEIEEDKLKRE

SEQ ID NO: 23484 - protein, 11 aa, Homo sapiens
KEIEEDKLKRE

SEQ ID NO: 23485 - protein, 11 aa, Homo sapiens
KEIEEDKLKRE

SEQ ID NO: 23486 - protein, 11 aa, Homo sapiens
KEIEEDKLKRE

SEQ ID NO: 23487 - protein, 11 aa, Homo sapiens
KEIEEDKLKRE

SEQ ID NO: 23488 - protein, 11 aa, Homo sapiens
KEIEEDKLKRE

SEQ ID NO: 23489 - protein, 11 aa, Homo sapiens
KEIEEDKLKRE

SEQ ID NO: 23490 - protein, 17 aa, Homo sapiens
KLNEVYEAVKNYTDKRG

SEQ ID NO: 23491 - protein, 7 aa, Homo sapiens
KLKLSRK

SEQ ID NO: 23492 - protein, 7 aa, Homo sapiens
KLKLSRK

SEQ ID NO: 23493 - protein, 19 aa, Homo sapiens
KRKELGPLPDDDDMASPKL

SEQ ID NO: 23494 - protein, 19 aa, Homo sapiens
KRKELGPLPDDDDMASPKL

SEQ ID NO: 23495 - protein, 8 aa, Homo sapiens
KLLKEKRK

SEQ ID NO: 23496 - protein, 19 aa, Homo sapiens
KRKELGPLPDDDDMASPKL

SEQ ID NO: 23497 - protein, 9 aa, Homo sapiens
RKSGISPKK

SEQ ID NO: 23498 - protein, 10 aa, Homo sapiens
RKSGISPKKS

SEQ ID NO: 23499 - protein, 9 aa, Homo sapiens
RKSGISPKK

SEQ ID NO: 23500 - protein, 7 aa, Homo sapiens
KKELARR

SEQ ID NO: 23501 - protein, 7 aa, Homo sapiens
KKELARR

SEQ ID NO: 23502 - protein, 7 aa, Homo sapiens
KKELARR

SEQ ID NO: 23503 - protein, 25 aa, Homo sapiens
RRDDIEDGDSMISSATSDTGSAKRK

SEQ ID NO: 23504 - protein, 25 aa, Homo sapiens
RRDDIEDGDSMISSATSDTGSAKRK

SEQ ID NO: 23505 - protein, 25 aa, Homo sapiens
RRDDIEDGDSMISSATSDTGSAKRK

SEQ ID NO: 23506 - protein, 8 aa, Homo sapiens
KKKELARR

SEQ ID NO: 23507 - protein, 17 aa, Homo sapiens
RKPIVPQKEPSPLLEKK

SEQ ID NO: 23508 - protein, 7 aa, Homo sapiens
KLKLSRK

SEQ ID NO: 23509 - protein, 17 aa, Homo sapiens
RKPIVPQKEPSPLLEKK

SEQ ID NO: 23510 - protein, 17 aa, Homo sapiens
RKPIVPQKEPSPLLEKK

SEQ ID NO: 23511 - protein, 23 aa, Homo sapiens
RNQPDYYEVVSQPIDLMKIQQKL

SEQ ID NO: 23512 - protein, 23 aa, Homo sapiens
RNQPDYYEVVSQPIDLMKIQQKL

SEQ ID NO: 23513 - protein, 11 aa, Homo sapiens
KEIEEDKLKRE

SEQ ID NO: 23514 - protein, 11 aa, Homo sapiens
KEIEEDKLKRE

SEQ ID NO: 23515 - protein, 14 aa, Homo sapiens
KRYNVPNSAIYKRV

SEQ ID NO: 23516 - protein, 13 aa, Homo sapiens
RVLKLQQVMQAKK

SEQ ID NO: 23517 - protein, 13 aa, Homo sapiens
RVLKLQQVMQAKK

SEQ ID NO: 23518 - protein, 13 aa, Homo sapiens
RVLKLQQVMQAKK

SEQ ID NO: 23519 - protein, 13 aa, Homo sapiens
RYNVPNSAIYKRV

SEQ ID NO: 23520 - protein, 14 aa, Homo sapiens
KRYNVPNSAIYKRV

SEQ ID NO: 23521 - protein, 13 aa, Homo sapiens
RVLKLQQVMQAKK

SEQ ID NO: 23522 - protein, 13 aa, Homo sapiens
RVLKLQQVMQAKK

SEQ ID NO: 23523 - protein, 13 aa, Homo sapiens
RVLKLQQVMQAKK

SEQ ID NO: 23524 - protein, 13 aa, Homo sapiens
RYNVPNSAIYKRV

SEQ ID NO: 23525 - protein, 14 aa, Homo sapiens
KRYNVPNSAIYKRV

SEQ ID NO: 23526 - protein, 13 aa, Homo sapiens
RVLKLQQVMQAKK

SEQ ID NO: 23527 - protein, 14 aa, Homo sapiens
KRYNVPNSAIYKRV

SEQ ID NO: 23528 - protein, 13 aa, Homo sapiens
RVLKLQQVMQAKK

SEQ ID NO: 23529 - protein, 14 aa, Homo sapiens
KRYNVPNSAIYKRV

SEQ ID NO: 23530 - protein, 13 aa, Homo sapiens
RYNVPNSAIYKRV

SEQ ID NO: 23531 - protein, 13 aa, Homo sapiens
RYNVPNSAIYKRV

SEQ ID NO: 23532 - protein, 13 aa, Homo sapiens
RYNVPNSAIYKRV

SEQ ID NO: 23533 - protein, 14 aa, Homo sapiens
KRYNVPNSAIYKRV

SEQ ID NO: 23534 - protein, 13 aa, Homo sapiens
RVLKLQQVMQAKK

SEQ ID NO: 23535 - protein, 13 aa, Homo sapiens
RVLKLQQVMQAKK

SEQ ID NO: 23536 - protein, 13 aa, Homo sapiens
RVLKLQQVMQAKK

SEQ ID NO: 23537 - protein, 14 aa, Homo sapiens
KRYNVPNSAIYKRV

SEQ ID NO: 23538 - protein, 13 aa, Homo sapiens
RVLKLQQVMQAKK

SEQ ID NO: 23539 - protein, 13 aa, Homo sapiens
RYNVPNSAIYKRV

SEQ ID NO: 23540 - protein, 13 aa, Homo sapiens
RYNVPNSAIYKRV

SEQ ID NO: 23541 - protein, 13 aa, Homo sapiens
RVLKLQQVMQAKK

SEQ ID NO: 23542 - protein, 14 aa, Homo sapiens
KRYNVPNSAIYKRV

SEQ ID NO: 23543 - protein, 13 aa, Homo sapiens
RYNVPNSAIYKRV

SEQ ID NO: 23544 - protein, 13 aa, Homo sapiens
RYNVPNSAIYKRV

SEQ ID NO: 23545 - protein, 13 aa, Homo sapiens
RVLKLQQVMQAKK

SEQ ID NO: 23546 - protein, 13 aa, Homo sapiens
RVLKLQQVMQAKK

SEQ ID NO: 23547 - protein, 13 aa, Homo sapiens
RVLKLQQVMQAKK

SEQ ID NO: 23548 - protein, 13 aa, Homo sapiens
RVLKLQQVMQAKK

SEQ ID NO: 23549 - protein, 13 aa, Homo sapiens
RVLKLQQVMQAKK

SEQ ID NO: 23550 - protein, 13 aa, Homo sapiens
RVLKLQQVMQAKK

SEQ ID NO: 23551 - protein, 13 aa, Homo sapiens
RVLKLQQVMQAKK

SEQ ID NO: 23552 - protein, 13 aa, Homo sapiens
RVLKLQQVMQAKK

SEQ ID NO: 23553 - protein, 13 aa, Homo sapiens
RYNVPNSAIYKRV

SEQ ID NO: 23554 - protein, 13 aa, Homo sapiens
RYNVPNSAIYKRV

SEQ ID NO: 23555 - protein, 8 aa, Homo sapiens
RYSAKTKS

SEQ ID NO: 23556 - protein, 21 aa, Homo sapiens
REAEKSEDSSGAAGLSGLHRT

SEQ ID NO: 23557 - protein, 21 aa, Homo sapiens
REAEKSEDSSGAAGLSGLHRT

SEQ ID NO: 23558 - protein, 7 aa, Homo sapiens
KEKLPKE

SEQ ID NO: 23559 - protein, 12 aa, Homo sapiens
KHLHNDVEKERK

SEQ ID NO: 23560 - protein, 8 aa, Homo sapiens
KFKGLKRF

SEQ ID NO: 23561 - protein, 8 aa, Homo sapiens
KFKGLKRF

SEQ ID NO: 23562 - protein, 12 aa, Homo sapiens
RYNESDKQMKKF

SEQ ID NO: 23563 - protein, 12 aa, Homo sapiens
RYNESDKQMKKF

SEQ ID NO: 23564 - protein, 12 aa, Homo sapiens
RYNESDKQMKKF

SEQ ID NO: 23565 - protein, 8 aa, Homo sapiens
KFKGLKRF

SEQ ID NO: 23566 - protein, 8 aa, Homo sapiens
KFKGLKRF

SEQ ID NO: 23567 - protein, 12 aa, Homo sapiens
RYNESDKQMKKF

SEQ ID NO: 23568 - protein, 8 aa, Homo sapiens
KFKGLKRF

SEQ ID NO: 23569 - protein, 8 aa, Homo sapiens
KFKGLKRF

SEQ ID NO: 23570 - protein, 8 aa, Homo sapiens
KFKGLKRF

SEQ ID NO: 23571 - protein, 8 aa, Homo sapiens
KFKGLKRF

SEQ ID NO: 23572 - protein, 8 aa, Homo sapiens
KFKGLKRF

SEQ ID NO: 23573 - protein, 8 aa, Homo sapiens
KFKGLKRF

SEQ ID NO: 23574 - protein, 12 aa, Homo sapiens
RYNESDKQMKKF

SEQ ID NO: 23575 - protein, 12 aa, Homo sapiens
RYNESDKQMKKF

SEQ ID NO: 23576 - protein, 8 aa, Homo sapiens
KFKGLKRF

SEQ ID NO: 23577 - protein, 12 aa, Homo sapiens
RYNESDKQMKKF

SEQ ID NO: 23578 - protein, 12 aa, Homo sapiens
RYNESDKQMKKF

SEQ ID NO: 23579 - protein, 12 aa, Homo sapiens
RYNESDKQMKKF

SEQ ID NO: 23580 - protein, 12 aa, Homo sapiens
RYNESDKQMKKF

SEQ ID NO: 23581 - protein, 12 aa, Homo sapiens
RYNESDKQMKKF

SEQ ID NO: 23582 - protein, 12 aa, Homo sapiens
RYNESDKQMKKF

SEQ ID NO: 23583 - protein, 10 aa, Homo sapiens
RNPTSKYYRN

SEQ ID NO: 23584 - protein, 10 aa, Homo sapiens
RNPTSKYYRN

SEQ ID NO: 23585 - protein, 7 aa, Homo sapiens
KLKLSRK

SEQ ID NO: 23586 - protein, 10 aa, Homo sapiens
RNPTSKYYRN

SEQ ID NO: 23587 - protein, 24 aa, Homo sapiens
KVQYPDYYAIIKEPIDLKTIAQRI

SEQ ID NO: 23588 - protein, 24 aa, Homo sapiens
KVQYPDYYAIIKEPIDLKTIAQRI

SEQ ID NO: 23589 - protein, 24 aa, Homo sapiens
KVQYPDYYAIIKEPIDLKTIAQRI

SEQ ID NO: 23590 - protein, 24 aa, Homo sapiens
KVQYPDYYAIIKEPIDLKTIAQRI

SEQ ID NO: 23591 - protein, 24 aa, Homo sapiens
KVQYPDYYAIIKEPIDLKTIAQRI

SEQ ID NO: 23592 - protein, 24 aa, Homo sapiens
KVQYPDYYAIIKEPIDLKTIAQRI

SEQ ID NO: 23593 - protein, 24 aa, Homo sapiens
KVQYPDYYAIIKEPIDLKTIAQRI

SEQ ID NO: 23594 - protein, 24 aa, Homo sapiens
KVQYPDYYAIIKEPIDLKTIAQRI

SEQ ID NO: 23595 - protein, 24 aa, Homo sapiens
KVQYPDYYAIIKEPIDLKTIAQRI

SEQ ID NO: 23596 - protein, 24 aa, Homo sapiens
KVQYPDYYAIIKEPIDLKTIAQRI

SEQ ID NO: 23597 - protein, 14 aa, Homo sapiens
RLISELFQKLPSKV

SEQ ID NO: 23598 - protein, 24 aa, Homo sapiens
KVQYPDYYAIIKEPIDLKTIAQRI

SEQ ID NO: 23599 - protein, 14 aa, Homo sapiens
RLISELFQKLPSKV

SEQ ID NO: 23600 - protein, 24 aa, Homo sapiens
KVQYPDYYAIIKEPIDLKTIAQRI

SEQ ID NO: 23601 - protein, 24 aa, Homo sapiens
KVQYPDYYAIIKEPIDLKTIAQRI

SEQ ID NO: 23602 - protein, 14 aa, Homo sapiens
RLISELFQKLPSKV

SEQ ID NO: 23603 - protein, 12 aa, Homo sapiens
RAAKVAEQQERE

SEQ ID NO: 23604 - protein, 12 aa, Homo sapiens
RAAKVAEQQERE

SEQ ID NO: 23605 - protein, 7 aa, Homo sapiens
KLKLSRK

SEQ ID NO: 23606 - protein, 18 aa, Homo sapiens
RKELGPLPDDDDMASPKL

SEQ ID NO: 23607 - protein, 20 aa, Homo sapiens
RKELGPLPDDDDMASPKLKL

SEQ ID NO: 23608 - protein, 21 aa, Homo sapiens
REAEKSEDSSGAAGLSGLHRT

SEQ ID NO: 23609 - protein, 21 aa, Homo sapiens
REAEKSEDSSGAAGLSGLHRT

SEQ ID NO: 23610 - protein, 22 aa, Homo sapiens
KREAEKSEDSSGAAGLSGLHRT

SEQ ID NO: 23611 - protein, 8 aa, Homo sapiens
KIFYMKKA

SEQ ID NO: 23612 - protein, 8 aa, Homo sapiens
KKFKGLKR

SEQ ID NO: 23613 - protein, 8 aa, Homo sapiens
KFKGLKRF

SEQ ID NO: 23614 - protein, 8 aa, Homo sapiens
KFKGLKRF

SEQ ID NO: 23615 - protein, 5 aa, Homo sapiens
KKFKG

SEQ ID NO: 23616 - protein, 5 aa, Homo sapiens
KKFKG

SEQ ID NO: 23617 - protein, 10 aa, Homo sapiens
KKIQLLEAKF

SEQ ID NO: 23618 - protein, 8 aa, Homo sapiens
KKKELARR

SEQ ID NO: 23619 - protein, 8 aa, Homo sapiens
KKKELARR

SEQ ID NO: 23620 - protein, 21 aa, Homo sapiens
REAEKSEDSSGAAGLSGLHRT

SEQ ID NO: 23621 - protein, 21 aa, Homo sapiens
REAEKSEDSSGAAGLSGLHRT

SEQ ID NO: 23622 - protein, 12 aa, Homo sapiens
RAAKVAEQQERE

SEQ ID NO: 23623 - protein, 14 aa, Homo sapiens
RAAKVAEQQERERA

SEQ ID NO: 23624 - protein, 9 aa, Homo sapiens
KKAEYEERA

SEQ ID NO: 23625 - protein, 12 aa, Homo sapiens
RAAKVAEQQERE

SEQ ID NO: 23626 - protein, 14 aa, Homo sapiens
RAAKVAEQQERERA

SEQ ID NO: 23627 - protein, 9 aa, Homo sapiens
KSAKGSAKK

SEQ ID NO: 23628 - protein, 9 aa, Homo sapiens
KSAKGSAKK

SEQ ID NO: 23629 - protein, 7 aa, Homo sapiens
REEEKRE

SEQ ID NO: 23630 - protein, 21 aa, Homo sapiens
REAEKSEDSSGAAGLSGLHRT

SEQ ID NO: 23631 - protein, 21 aa, Homo sapiens
REAEKSEDSSGAAGLSGLHRT

SEQ ID NO: 23632 - protein, 21 aa, Homo sapiens
REAEKSEDSSGAAGLSGLHRT

SEQ ID NO: 23633 - protein, 21 aa, Homo sapiens
REAEKSEDSSGAAGLSGLHRT

SEQ ID NO: 23634 - protein, 21 aa, Homo sapiens
REAEKSEDSSGAAGLSGLHRT

SEQ ID NO: 23635 - protein, 21 aa, Homo sapiens
REAEKSEDSSGAAGLSGLHRT

SEQ ID NO: 23636 - protein, 21 aa, Homo sapiens
REAEKSEDSSGAAGLSGLHRT

SEQ ID NO: 23637 - protein, 25 aa, Homo sapiens
RRDDIEDGDSMISSATSDTGSAKRK

SEQ ID NO: 23638 - protein, 25 aa, Homo sapiens
RRDDIEDGDSMISSATSDTGSAKRK

SEQ ID NO: 23639 - protein, 25 aa, Homo sapiens
RRDDIEDGDSMISSATSDTGSAKRK

SEQ ID NO: 23640 - protein, 13 aa, Homo sapiens
RDVHLSKEQESRL

SEQ ID NO: 23641 - protein, 13 aa, Homo sapiens
RDVHLSKEQESRL

SEQ ID NO: 23642 - protein, 13 aa, Homo sapiens
RDVHLSKEQESRL

SEQ ID NO: 23643 - protein, 17 aa, Homo sapiens
RLTGPSHSKGSLGEERN

SEQ ID NO: 23644 - protein, 13 aa, Homo sapiens
RYNVPNSAIYKRV

SEQ ID NO: 23645 - protein, 17 aa, Homo sapiens
RLTGPSHSKGSLGEERN

SEQ ID NO: 23646 - protein, 10 aa, Homo sapiens
RNPTSKYYRN

SEQ ID NO: 23647 - protein, 10 aa, Homo sapiens
RNPTSKYYRN

SEQ ID NO: 23648 - protein, 17 aa, Homo sapiens
RLTGPSHSKGSLGEERN

SEQ ID NO: 23649 - protein, 17 aa, Homo sapiens
RLTGPSHSKGSLGEERN

SEQ ID NO: 23650 - protein, 17 aa, Homo sapiens
RLTGPSHSKGSLGEERN

SEQ ID NO: 23651 - protein, 10 aa, Homo sapiens
RNPTSKYYRN

SEQ ID NO: 23652 - protein, 17 aa, Homo sapiens
RLTGPSHSKGSLGEERN

SEQ ID NO: 23653 - protein, 10 aa, Homo sapiens
RNPTSKYYRN

SEQ ID NO: 23654 - protein, 10 aa, Homo sapiens
RNPTSKYYRN

SEQ ID NO: 23655 - protein, 10 aa, Homo sapiens
RNPTSKYYRN

SEQ ID NO: 23656 - protein, 10 aa, Homo sapiens
RNPTSKYYRN

SEQ ID NO: 23657 - protein, 13 aa, Homo sapiens
RVLKLQQVMQAKK

SEQ ID NO: 23658 - protein, 17 aa, Homo sapiens
RLTGPSHSKGSLGEERN

SEQ ID NO: 23659 - protein, 7 aa, Homo sapiens
KLKLSRK

SEQ ID NO: 23660 - protein, 13 aa, Homo sapiens
RVLKLQQVMQAKK

SEQ ID NO: 23661 - protein, 13 aa, Homo sapiens
RVLKLQQVMQAKK

SEQ ID NO: 23662 - protein, 8 aa, Homo sapiens
KKKELARR

SEQ ID NO: 23663 - protein, 9 aa, Homo sapiens
RKSGISPKK

SEQ ID NO: 23664 - protein, 13 aa, Homo sapiens
RVLKLQQVMQAKK

SEQ ID NO: 23665 - protein, 13 aa, Homo sapiens
RVLKLQQVMQAKK

SEQ ID NO: 23666 - protein, 13 aa, Homo sapiens
RVLKLQQVMQAKK

SEQ ID NO: 23667 - protein, 13 aa, Homo sapiens
RVLKLQQVMQAKK

SEQ ID NO: 23668 - protein, 13 aa, Homo sapiens
RVLKLQQVMQAKK

SEQ ID NO: 23669 - protein, 7 aa, Homo sapiens
KKELARR

SEQ ID NO: 23670 - protein, 7 aa, Homo sapiens
KKELARR

SEQ ID NO: 23671 - protein, 13 aa, Homo sapiens
RVLKLQQVMQAKK

SEQ ID NO: 23672 - protein, 8 aa, Homo sapiens
KKKELARR

SEQ ID NO: 23673 - protein, 8 aa, Homo sapiens
KKKELARR

SEQ ID NO: 23674 - protein, 14 aa, Homo sapiens
KRVLKLQQVMQAKK

SEQ ID NO: 23675 - protein, 13 aa, Homo sapiens
RVLKLQQVMQAKK

SEQ ID NO: 23676 - protein, 19 aa, Homo sapiens
RAVIKAQHPDYSFGELSRL

SEQ ID NO: 23677 - protein, 19 aa, Homo sapiens
RAVIKAQHPDYSFGELSRL

SEQ ID NO: 23678 - protein, 19 aa, Homo sapiens
RAVIKAQHPDYSFGELSRL

SEQ ID NO: 23679 - protein, 19 aa, Homo sapiens
RAVIKAQHPDYSFGELSRL

SEQ ID NO: 23680 - protein, 19 aa, Homo sapiens
RAVIKAQHPDYSFGELSRL

SEQ ID NO: 23681 - protein, 9 aa, Homo sapiens
RNLETAKKA

SEQ ID NO: 23682 - protein, 19 aa, Homo sapiens
RAVIKAQHPDYSFGELSRL

SEQ ID NO: 23683 - protein, 19 aa, Homo sapiens
RAVIKAQHPDYSFGELSRL

SEQ ID NO: 23684 - protein, 19 aa, Homo sapiens
RAVIKAQHPDYSFGELSRL

SEQ ID NO: 23685 - protein, 19 aa, Homo sapiens
RAVIKAQHPDYSFGELSRL

SEQ ID NO: 23686 - protein, 19 aa, Homo sapiens
RAVIKAQHPDYSFGELSRL

SEQ ID NO: 23687 - protein, 19 aa, Homo sapiens
RAVIKAQHPDYSFGELSRL

SEQ ID NO: 23688 - protein, 14 aa, Homo sapiens
RLCDLFMVKPSKKD

SEQ ID NO: 23689 - protein, 13 aa, Homo sapiens
RLCDLFMVKPSKK

SEQ ID NO: 23690 - protein, 10 aa, Homo sapiens
KKDYPDYYKI

SEQ ID NO: 23691 - protein, 10 aa, Homo sapiens
KKDYPDYYKI

SEQ ID NO: 23692 - protein, 13 aa, Homo sapiens
RLCDLFMVKPSKK

SEQ ID NO: 23693 - protein, 13 aa, Homo sapiens
RLCDLFMVKPSKK

SEQ ID NO: 23694 - protein, 10 aa, Homo sapiens
KKDYPDYYKI

SEQ ID NO: 23695 - protein, 10 aa, Homo sapiens
KKDYPDYYKI

SEQ ID NO: 23696 - protein, 10 aa, Homo sapiens
KKDYPDYYKI

SEQ ID NO: 23697 - protein, 13 aa, Homo sapiens
RLCDLFMVKPSKK

SEQ ID NO: 23698 - protein, 10 aa, Homo sapiens
KKDYPDYYKI

SEQ ID NO: 23699 - protein, 10 aa, Homo sapiens
KKDYPDYYKI

SEQ ID NO: 23700 - protein, 13 aa, Homo sapiens
RLCDLFMVKPSKK

SEQ ID NO: 23701 - protein, 13 aa, Homo sapiens
RLCDLFMVKPSKK

SEQ ID NO: 23702 - protein, 10 aa, Homo sapiens
KKDYPDYYKI

SEQ ID NO: 23703 - protein, 10 aa, Homo sapiens
KKIQLLEAKF

SEQ ID NO: 23704 - protein, 10 aa, Homo sapiens
KKIQLLEAKF

SEQ ID NO: 23705 - protein, 12 aa, Homo sapiens
RLDGTTKAEDRG

SEQ ID NO: 23706 - protein, 18 aa, Homo sapiens
RKRDSDAGSSTPTTSTRS

SEQ ID NO: 23707 - protein, 12 aa, Homo sapiens
KVSYKGSPAARR

SEQ ID NO: 23708 - protein, 12 aa, Homo sapiens
KVSYKGSPAARR

SEQ ID NO: 23709 - protein, 17 aa, Homo sapiens
RDTALETALNAKAYKRS

SEQ ID NO: 23710 - protein, 17 aa, Homo sapiens
RDTALETALNAKAYKRS

SEQ ID NO: 23711 - protein, 17 aa, Homo sapiens
RDTALETALNAKAYKRS

SEQ ID NO: 23712 - protein, 17 aa, Homo sapiens
RDTALETALNAKAYKRS

SEQ ID NO: 23713 - protein, 9 aa, Homo sapiens
KVKIKLGRK

SEQ ID NO: 23714 - protein, 9 aa, Homo sapiens
KVKIKLGRK

SEQ ID NO: 23715 - protein, 9 aa, Homo sapiens
KVKIKLGRK

SEQ ID NO: 23716 - protein, 7 aa, Homo sapiens
KIKLGRK

SEQ ID NO: 23717 - protein, 7 aa, Homo sapiens
KIKLGRK

SEQ ID NO: 23718 - protein, 7 aa, Homo sapiens
KIKLGRK

SEQ ID NO: 23719 - protein, 9 aa, Homo sapiens
RKEKAQDRL

SEQ ID NO: 23720 - protein, 7 aa, Homo sapiens
KIKLGRK

SEQ ID NO: 23721 - protein, 9 aa, Homo sapiens
RKEKAQDRL

SEQ ID NO: 23722 - protein, 9 aa, Homo sapiens
RKEKAQDRL

SEQ ID NO: 23723 - protein, 9 aa, Homo sapiens
RKEKAQDRL

SEQ ID NO: 23724 - protein, 8 aa, Homo sapiens
KEKAQDRL

SEQ ID NO: 23725 - protein, 8 aa, Homo sapiens
KEKAQDRL

SEQ ID NO: 23726 - protein, 7 aa, Homo sapiens
RLKGGRR

SEQ ID NO: 23727 - protein, 7 aa, Homo sapiens
RLKGGRR

SEQ ID NO: 23728 - protein, 9 aa, Homo sapiens
RITEKLEKQ

SEQ ID NO: 23729 - protein, 13 aa, Homo sapiens
RKELPEYYELIRK

SEQ ID NO: 23730 - protein, 7 aa, Homo sapiens
RLKGGRR

SEQ ID NO: 23731 - protein, 6 aa, Homo sapiens
KVKIKL

SEQ ID NO: 23732 - protein, 9 aa, Homo sapiens
RSVKVKIKL

SEQ ID NO: 23733 - protein, 6 aa, Homo sapiens
KVKIKL

SEQ ID NO: 23734 - protein, 19 aa, Homo sapiens
KVIHVESGKILTGTDAPKA

SEQ ID NO: 23735 - protein, 19 aa, Homo sapiens
KKKIPDPDSDDVSEVDARH

SEQ ID NO: 23736 - protein, 15 aa, Homo sapiens
RLTCEEEEEKMFGRG

SEQ ID NO: 23737 - protein, 15 aa, Homo sapiens
RLTCEEEEEKMFGRG

SEQ ID NO: 23738 - protein, 15 aa, Homo sapiens
RLTCEEEEEKMFGRG

SEQ ID NO: 23739 - protein, 15 aa, Homo sapiens
RLTCEEEEEKMFGRG

SEQ ID NO: 23740 - protein, 24 aa, Homo sapiens
RHIIENAKQDVDDEYGVSQALARG

SEQ ID NO: 23741 - protein, 12 aa, Homo sapiens
KVSYKGSPAARR

SEQ ID NO: 23742 - protein, 13 aa, Homo sapiens
RKELPEYYELIRK

SEQ ID NO: 23743 - protein, 9 aa, Homo sapiens
RKEKAQDRL

SEQ ID NO: 23744 - protein, 10 aa, Homo sapiens
RSVTGKIQKL

SEQ ID NO: 23745 - protein, 11 aa, Homo sapiens
RKEKLPQVTRS

SEQ ID NO: 23746 - protein, 25 aa, Homo sapiens
RELFQEMNIELVPPYMIASKEAVRE

SEQ ID NO: 23747 - protein, 25 aa, Homo sapiens
RELFQEMNIELVPPYMIASKEAVRE

SEQ ID NO: 23748 - protein, 11 aa, Homo sapiens
RKEKLPQVTRS

SEQ ID NO: 23749 - protein, 15 aa, Homo sapiens
KQEYEEGGKQCVERK

SEQ ID NO: 23750 - protein, 15 aa, Homo sapiens
KQEYEEGGKQCVERK

SEQ ID NO: 23751 - protein, 15 aa, Homo sapiens
KQEYEEGGKQCVERK

SEQ ID NO: 23752 - protein, 15 aa, Homo sapiens
KQEYEEGGKQCVERK

SEQ ID NO: 23753 - protein, 15 aa, Homo sapiens
KQEYEEGGKQCVERK

SEQ ID NO: 23754 - protein, 22 aa, Homo sapiens
REKLTELMFEHYNIPAFFLCKT

SEQ ID NO: 23755 - protein, 22 aa, Homo sapiens
REKLTELMFEHYNIPAFFLCKT

SEQ ID NO: 23756 - protein, 11 aa, Homo sapiens
REGSPANWKRK

SEQ ID NO: 23757 - protein, 11 aa, Homo sapiens
RKEKLPQVTRS

SEQ ID NO: 23758 - protein, 11 aa, Homo sapiens
RKEKLPQVTRS

SEQ ID NO: 23759 - protein, 11 aa, Homo sapiens
REGSPANWKRK

SEQ ID NO: 23760 - protein, 11 aa, Homo sapiens
REGSPANWKRK

SEQ ID NO: 23761 - protein, 11 aa, Homo sapiens
REGSPANWKRK

SEQ ID NO: 23762 - protein, 11 aa, Homo sapiens
REGSPANWKRK

SEQ ID NO: 23763 - protein, 11 aa, Homo sapiens
RKEKLPQVTRS

SEQ ID NO: 23764 - protein, 11 aa, Homo sapiens
RKEKLPQVTRS

SEQ ID NO: 23765 - protein, 11 aa, Homo sapiens
REGSPANWKRK

SEQ ID NO: 23766 - protein, 11 aa, Homo sapiens
REGSPANWKRK

SEQ ID NO: 23767 - protein, 11 aa, Homo sapiens
REGSPANWKRK

SEQ ID NO: 23768 - protein, 11 aa, Homo sapiens
REGSPANWKRK

SEQ ID NO: 23769 - protein, 11 aa, Homo sapiens
REGSPANWKRK

SEQ ID NO: 23770 - protein, 11 aa, Homo sapiens
REGSPANWKRK

SEQ ID NO: 23771 - protein, 11 aa, Homo sapiens
REGSPANWKRK

SEQ ID NO: 23772 - protein, 15 aa, Homo sapiens
KEAVREGSPANWKRK

SEQ ID NO: 23773 - protein, 15 aa, Homo sapiens
KEAVREGSPANWKRK

SEQ ID NO: 23774 - protein, 11 aa, Homo sapiens
REGSPANWKRK

SEQ ID NO: 23775 - protein, 15 aa, Homo sapiens
KEAVREGSPANWKRK

SEQ ID NO: 23776 - protein, 11 aa, Homo sapiens
RKEKLPQVTRS

SEQ ID NO: 23777 - protein, 11 aa, Homo sapiens
REGSPANWKRK

SEQ ID NO: 23778 - protein, 15 aa, Homo sapiens
KEAVREGSPANWKRK

SEQ ID NO: 23779 - protein, 11 aa, Homo sapiens
RKEKLPQVTRS

SEQ ID NO: 23780 - protein, 11 aa, Homo sapiens
REGSPANWKRK

SEQ ID NO: 23781 - protein, 11 aa, Homo sapiens
REGSPANWKRK

SEQ ID NO: 23782 - protein, 11 aa, Homo sapiens
REGSPANWKRK

SEQ ID NO: 23783 - protein, 15 aa, Homo sapiens
KEAVREGSPANWKRK

SEQ ID NO: 23784 - protein, 11 aa, Homo sapiens
REGSPANWKRK

SEQ ID NO: 23785 - protein, 15 aa, Homo sapiens
KEAVREGSPANWKRK

SEQ ID NO: 23786 - protein, 11 aa, Homo sapiens
REGSPANWKRK

SEQ ID NO: 23787 - protein, 11 aa, Homo sapiens
REGSPANWKRK

SEQ ID NO: 23788 - protein, 9 aa, Homo sapiens
RAKDDIKKV

SEQ ID NO: 23789 - protein, 8 aa, Homo sapiens
RAKDDIKR

SEQ ID NO: 23790 - protein, 10 aa, Homo sapiens
RSRAKDDIKR

SEQ ID NO: 23791 - protein, 11 aa, Homo sapiens
RVMAAIEKVRK

SEQ ID NO: 23792 - protein, 13 aa, Homo sapiens
RIYKWVPVTEPKV

SEQ ID NO: 23793 - protein, 13 aa, Homo sapiens
RIYKWVPVTEPKV

SEQ ID NO: 23794 - protein, 6 aa, Homo sapiens
RKWEKK

SEQ ID NO: 23795 - protein, 7 aa, Homo sapiens
RKWEKKW

SEQ ID NO: 23796 - protein, 11 aa, Homo sapiens
RVMAAIEKVRK

SEQ ID NO: 23797 - protein, 11 aa, Homo sapiens
RVMAAIEKVRK

SEQ ID NO: 23798 - protein, 9 aa, Homo sapiens
RAKDDIKRV

SEQ ID NO: 23799 - protein, 9 aa, Homo sapiens
RAKDDIKRV

SEQ ID NO: 23800 - protein, 9 aa, Homo sapiens
RAKDDIKRV

SEQ ID NO: 23801 - protein, 9 aa, Homo sapiens
RAKDDIKRV

SEQ ID NO: 23802 - protein, 11 aa, Homo sapiens
RVMAAIEKVRK

SEQ ID NO: 23803 - protein, 9 aa, Homo sapiens
RAKDDIKRV

SEQ ID NO: 23804 - protein, 11 aa, Homo sapiens
RVMAAIEKVRK

SEQ ID NO: 23805 - protein, 11 aa, Homo sapiens
RVMAAIEKVRK

SEQ ID NO: 23806 - protein, 9 aa, Homo sapiens
RAKDDIKRV

SEQ ID NO: 23807 - protein, 11 aa, Homo sapiens
RVMAAIEKVRK

SEQ ID NO: 23808 - protein, 13 aa, Homo sapiens
RIYKWVPVTEPKV

SEQ ID NO: 23809 - protein, 12 aa, Homo sapiens
RTVFPNHTVKRV

SEQ ID NO: 23810 - protein, 12 aa, Homo sapiens
RTVFPNHTVKRV

SEQ ID NO: 23811 - protein, 13 aa, Homo sapiens
RRKGLAFLDELRQ

SEQ ID NO: 23812 - protein, 21 aa, Homo sapiens
KDALLAGLKQDEPGQAGSQKS

SEQ ID NO: 23813 - protein, 21 aa, Homo sapiens
KDALLAGLKQDEPGQAGSQKS

SEQ ID NO: 23814 - protein, 18 aa, Homo sapiens
KSSTKQPTVGGTSSTPRA

SEQ ID NO: 23815 - protein, 19 aa, Homo sapiens
RAQKAIVNHPSAALMALRR

SEQ ID NO: 23816 - protein, 18 aa, Homo sapiens
KSSTKQPTVGGTSSTPRA

SEQ ID NO: 23817 - protein, 19 aa, Homo sapiens
RAQKAIVNHPSAALMALRR

SEQ ID NO: 23818 - protein, 19 aa, Homo sapiens
RAQKAIVNHPSAALMALRR

SEQ ID NO: 23819 - protein, 12 aa, Homo sapiens
KLLDDPSKQKRK

SEQ ID NO: 23820 - protein, 12 aa, Homo sapiens
KLLDDPSKQKRK

SEQ ID NO: 23821 - protein, 12 aa, Homo sapiens
KLLDDPSKQKRK

SEQ ID NO: 23822 - protein, 9 aa, Homo sapiens
RKFSSFFKS

SEQ ID NO: 23823 - protein, 12 aa, Homo sapiens
KLLDDPSKQKRK

SEQ ID NO: 23824 - protein, 13 aa, Homo sapiens
RVEGKLLDDPSKQ

SEQ ID NO: 23825 - protein, 13 aa, Homo sapiens
RVEGKLLDDPSKQ

SEQ ID NO: 23826 - protein, 10 aa, Homo sapiens
RKLDQTIARK

SEQ ID NO: 23827 - protein, 12 aa, Homo sapiens
RKMADKVLPQRI

SEQ ID NO: 23828 - protein, 11 aa, Homo sapiens
RMEIQEAIKKP

SEQ ID NO: 23829 - protein, 11 aa, Homo sapiens
RMEIQEAIKKP

SEQ ID NO: 23830 - protein, 9 aa, Homo sapiens
RKFSSFFKS

SEQ ID NO: 23831 - protein, 29 aa, Homo sapiens
RIFISNTFNPAKSDAEDGEGTVASWELRV

SEQ ID NO: 23832 - protein, 21 aa, Homo sapiens
RKRPAPQQIQQVQQQAVQNRN

SEQ ID NO: 23833 - protein, 21 aa, Homo sapiens
RKRPAPQQIQQVQQQAVQNRN

SEQ ID NO: 23834 - protein, 10 aa, Homo sapiens
RKLDQTIMRK

SEQ ID NO: 23835 - protein, 21 aa, Homo sapiens
RKRPAPQQIQQVQQQAVQNRN

SEQ ID NO: 23836 - protein, 11 aa, Homo sapiens
RLDIQEALKRP

SEQ ID NO: 23837 - protein, 12 aa, Homo sapiens
KRLDIQEALKRP

SEQ ID NO: 23838 - protein, 11 aa, Homo sapiens
RYFYSKVQQRR

SEQ ID NO: 23839 - protein, 10 aa, Homo sapiens
RKLDQTIMRK

SEQ ID NO: 23840 - protein, 19 aa, Homo sapiens
TPQQTSASQQMLNFPDKGK

SEQ ID NO: 23841 - protein, 12 aa, Homo sapiens
EKPTDMQNFGLR

SEQ ID NO: 23842 - protein, 12 aa, Homo sapiens
EKPTDMQNFGLR

SEQ ID NO: 23843 - protein, 12 aa, Homo sapiens
EKPTDMQNFGLR

SEQ ID NO: 23844 - protein, 19 aa, Homo sapiens
TPQQTSASQQMLNFPDKGK

SEQ ID NO: 23845 - protein, 19 aa, Homo sapiens
TPQQTSASQQMLNFPDKGK

SEQ ID NO: 23846 - protein, 19 aa, Homo sapiens
TPQQTSASQQMLNFPDKGK

SEQ ID NO: 23847 - protein, 19 aa, Homo sapiens
TPQQTSASQQMLNFPDKGK

SEQ ID NO: 23848 - protein, 9 aa, Homo sapiens
SKAAASATR

SEQ ID NO: 23849 - protein, 9 aa, Homo sapiens
SKAAASATR

SEQ ID NO: 23850 - protein, 9 aa, Homo sapiens
SKAAASATR

SEQ ID NO: 23851 - protein, 9 aa, Homo sapiens
SKAAASATR

SEQ ID NO: 23852 - protein, 9 aa, Homo sapiens
SKAAASATR

SEQ ID NO: 23853 - protein, 9 aa, Homo sapiens
SKAAASATR

SEQ ID NO: 23854 - protein, 9 aa, Homo sapiens
SKAAASATR

SEQ ID NO: 23855 - protein, 7 aa, Homo sapiens
TDMYTKK

SEQ ID NO: 23856 - protein, 9 aa, Homo sapiens
SKAAASATR

SEQ ID NO: 23857 - protein, 9 aa, Homo sapiens
SKAAASATR

SEQ ID NO: 23858 - protein, 9 aa, Homo sapiens
SKAAASATR

SEQ ID NO: 23859 - protein, 9 aa, Homo sapiens
SKAAASATR

SEQ ID NO: 23860 - protein, 9 aa, Homo sapiens
SKAAASATR

SEQ ID NO: 23861 - protein, 7 aa, Homo sapiens
TDMYTKK

SEQ ID NO: 23862 - protein, 10 aa, Homo sapiens
VEGQATDEKK

SEQ ID NO: 23863 - protein, 10 aa, Homo sapiens
VEGQATDEKK

SEQ ID NO: 23864 - protein, 10 aa, Homo sapiens
VEGQATDEKK

SEQ ID NO: 23865 - protein, 6 aa, Homo sapiens
EPKEPR

SEQ ID NO: 23866 - protein, 10 aa, Homo sapiens
VEGQATDEKK

SEQ ID NO: 23867 - protein, 10 aa, Homo sapiens
VEGQATDEKK

SEQ ID NO: 23868 - protein, 10 aa, Homo sapiens
VEGQATDEKK

SEQ ID NO: 23869 - protein, 10 aa, Homo sapiens
VEGQATDEKK

SEQ ID NO: 23870 - protein, 10 aa, Homo sapiens
VEGQATDEKK

SEQ ID NO: 23871 - protein, 10 aa, Homo sapiens
VEGQATDEKK

SEQ ID NO: 23872 - protein, 6 aa, Homo sapiens
EPKEPR

SEQ ID NO: 23873 - protein, 6 aa, Homo sapiens
EPKEPR

SEQ ID NO: 23874 - protein, 10 aa, Homo sapiens
VEGQATDEKK

SEQ ID NO: 23875 - protein, 6 aa, Homo sapiens
EPKEPR

SEQ ID NO: 23876 - protein, 10 aa, Homo sapiens
VEGQATDEKK

SEQ ID NO: 23877 - protein, 6 aa, Homo sapiens
KTKVER

SEQ ID NO: 23878 - protein, 17 aa, Homo sapiens
EGQEEVLKEVVESEGER

SEQ ID NO: 23879 - protein, 17 aa, Homo sapiens
EGQEEVLKEVVESEGER

SEQ ID NO: 23880 - protein, 6 aa, Homo sapiens
KTKVER

SEQ ID NO: 23881 - protein, 17 aa, Homo sapiens
EGQEEVLKEVVESEGER

SEQ ID NO: 23882 - protein, 17 aa, Homo sapiens
EGQEEVLKEVVESEGER

SEQ ID NO: 23883 - protein, 6 aa, Homo sapiens
KTKVER

SEQ ID NO: 23884 - protein, 17 aa, Homo sapiens
EGQEEVLKEVVESEGER

SEQ ID NO: 23885 - protein, 6 aa, Homo sapiens
KTKVER

SEQ ID NO: 23886 - protein, 17 aa, Homo sapiens
EGQEEVLKEVVESEGER

SEQ ID NO: 23887 - protein, 17 aa, Homo sapiens
EGQEEVLKEVVESEGER

SEQ ID NO: 23888 - protein, 6 aa, Homo sapiens
KTKVER

SEQ ID NO: 23889 - protein, 17 aa, Homo sapiens
EGQEEVLKEVVESEGER

SEQ ID NO: 23890 - protein, 17 aa, Homo sapiens
EGQEEVLKEVVESEGER

SEQ ID NO: 23891 - protein, 17 aa, Homo sapiens
EGQEEVLKEVVESEGER

SEQ ID NO: 23892 - protein, 6 aa, Homo sapiens
KTKVER

SEQ ID NO: 23893 - protein, 6 aa, Homo sapiens
KTKVER

SEQ ID NO: 23894 - protein, 17 aa, Homo sapiens
EGQEEVLKEVVESEGER

SEQ ID NO: 23895 - protein, 6 aa, Homo sapiens
KTKVER

SEQ ID NO: 23896 - protein, 17 aa, Homo sapiens
EGQEEVLKEVVESEGER

SEQ ID NO: 23897 - protein, 15 aa, Homo sapiens
VASAAAKSALEEFSK

SEQ ID NO: 23898 - protein, 15 aa, Homo sapiens
VASAAAKSALEEFSK

SEQ ID NO: 23899 - protein, 15 aa, Homo sapiens
VASAAAKSALEEFSK

SEQ ID NO: 23900 - protein, 15 aa, Homo sapiens
MKEEVPTALVEAHVR

SEQ ID NO: 23901 - protein, 15 aa, Homo sapiens
VASAAAKSALEEFSK

SEQ ID NO: 23902 - protein, 15 aa, Homo sapiens
MKEEVPTALVEAHVR

SEQ ID NO: 23903 - protein, 15 aa, Homo sapiens
MKEEVPTALVEAHVR

SEQ ID NO: 23904 - protein, 15 aa, Homo sapiens
MKEEVPTALVEAHVR

SEQ ID NO: 23905 - protein, 15 aa, Homo sapiens
MKEEVPTALVEAHVR

SEQ ID NO: 23906 - protein, 15 aa, Homo sapiens
MKEEVPTALVEAHVR

SEQ ID NO: 23907 - protein, 15 aa, Homo sapiens
MKEEVPTALVEAHVR

SEQ ID NO: 23908 - protein, 15 aa, Homo sapiens
VASAAAKSALEEFSK

SEQ ID NO: 23909 - protein, 15 aa, Homo sapiens
MKEEVPTALVEAHVR

SEQ ID NO: 23910 - protein, 15 aa, Homo sapiens
MKEEVPTALVEAHVR

SEQ ID NO: 23911 - protein, 15 aa, Homo sapiens
MKEEVPTALVEAHVR

SEQ ID NO: 23912 - protein, 15 aa, Homo sapiens
VASAAAKSALEEFSK

SEQ ID NO: 23913 - protein, 15 aa, Homo sapiens
VASAAAKSALEEFSK

SEQ ID NO: 23914 - protein, 15 aa, Homo sapiens
VASAAAKSALEEFSK

SEQ ID NO: 23915 - protein, 15 aa, Homo sapiens
VASAAAKSALEEFSK

SEQ ID NO: 23916 - protein, 15 aa, Homo sapiens
VASAAAKSALEEFSK

SEQ ID NO: 23917 - protein, 15 aa, Homo sapiens
VASAAAKSALEEFSK

SEQ ID NO: 23918 - protein, 15 aa, Homo sapiens
MKEEVPTALVEAHVR

SEQ ID NO: 23919 - protein, 26 aa, Homo sapiens
TKVERDIGEGNLSTAAAAALAAAAVK

SEQ ID NO: 23920 - protein, 15 aa, Homo sapiens
VASAAAKSALEEFSK

SEQ ID NO: 23921 - protein, 15 aa, Homo sapiens
VASAAAKSALEEFSK

SEQ ID NO: 23922 - protein, 15 aa, Homo sapiens
VASAAAKSALEEFSK

SEQ ID NO: 23923 - protein, 15 aa, Homo sapiens
VASAAAKSALEEFSK

SEQ ID NO: 23924 - protein, 15 aa, Homo sapiens
VASAAAKSALEEFSK

SEQ ID NO: 23925 - protein, 6 aa, Homo sapiens
KTKVER

SEQ ID NO: 23926 - protein, 10 aa, Homo sapiens
AKHLAAVEER

SEQ ID NO: 23927 - protein, 10 aa, Homo sapiens
AKHLAAVEER

SEQ ID NO: 23928 - protein, 36 aa, Homo sapiens; identical to SEQ ID NO: 8480

SEQ ID NO: 23929 - protein, 36 aa, Homo sapiens; identical to SEQ ID NO: 8480

SEQ ID NO: 23930 - protein, 36 aa, Homo sapiens; identical to SEQ ID NO: 8480

SEQ ID NO: 23931 - protein, 7 aa, Homo sapiens
KVEEAAK

SEQ ID NO: 23932 - protein, 7 aa, Homo sapiens
KVEEAAK

SEQ ID NO: 23933 - protein, 7 aa, Homo sapiens
KVEEAAK

SEQ ID NO: 23934 - protein, 7 aa, Homo sapiens
KVEEAAK

SEQ ID NO: 23935 - protein, 6 aa, Homo sapiens
KTKVER

SEQ ID NO: 23936 - protein, 10 aa, Homo sapiens
AKHLAAVEER

SEQ ID NO: 23937 - protein, 9 aa, Homo sapiens
SKAAASATR

SEQ ID NO: 23938 - protein, 9 aa, Homo sapiens
SKAAASATR

SEQ ID NO: 23939 - protein, 15 aa, Homo sapiens
MKEEVPTALVEAHVR

SEQ ID NO: 23940 - protein, 15 aa, Homo sapiens
MKEEVPTALVEAHVR

SEQ ID NO: 23941 - protein, 13 aa, Homo sapiens
EGGGAIEEEAKEK

SEQ ID NO: 23942 - protein, 13 aa, Homo sapiens
EGGGAIEEEAKEK

SEQ ID NO: 23943 - protein, 13 aa, Homo sapiens
EGGGAIEEEAKEK

SEQ ID NO: 23944 - protein, 13 aa, Homo sapiens
EGGGAIEEEAKEK

SEQ ID NO: 23945 - protein, 13 aa, Homo sapiens
EGGGAIEEEAKEK

SEQ ID NO: 23946 - protein, 11 aa, Homo sapiens
TSEAPKKDEEK

SEQ ID NO: 23947 - protein, 13 aa, Homo sapiens
EGGGAIEEEAKEK

SEQ ID NO: 23948 - protein, 11 aa, Homo sapiens
TSEAPKKDEEK

SEQ ID NO: 23949 - protein, 7 aa, Homo sapiens
KDEEKGK

SEQ ID NO: 23950 - protein, 13 aa, Homo sapiens
EGGGAIEEEAKEK

SEQ ID NO: 23951 - protein, 5 aa, Homo sapiens
TKVER

SEQ ID NO: 23952 - protein, 5 aa, Homo sapiens
TKVER

SEQ ID NO: 23953 - protein, 11 aa, Homo sapiens
KVEEAAKVTGK

SEQ ID NO: 23954 - protein, 11 aa, Homo sapiens
KVEEAAKVTGK

SEQ ID NO: 23955 - protein, 6 aa, Homo sapiens
KTKVER

SEQ ID NO: 23956 - protein, 6 aa, Homo sapiens
KNVPSK

SEQ ID NO: 23957 - protein, 9 aa, Homo sapiens
SKAAASATR

SEQ ID NO: 23958 - protein, 9 aa, Homo sapiens
SKAAASATR

SEQ ID NO: 23959 - protein, 9 aa, Homo sapiens
SKAAASATR

SEQ ID NO: 23960 - protein, 9 aa, Homo sapiens
SKAAASATR

SEQ ID NO: 23961 - protein, 9 aa, Homo sapiens
SKAAASATR

SEQ ID NO: 23962 - protein, 9 aa, Homo sapiens
SKAAASATR

SEQ ID NO: 23963 - protein, 9 aa, Homo sapiens
SKAAASATR

SEQ ID NO: 23964 - protein, 6 aa, Homo sapiens
KNVPSK

SEQ ID NO: 23965 - protein, 7 aa, Homo sapiens
TDMYTKK

SEQ ID NO: 23966 - protein, 10 aa, Homo sapiens
AKHLAAVEER

SEQ ID NO: 23967 - protein, 15 aa, Homo sapiens
MKEEVPTALVEAHVR

SEQ ID NO: 23968 - protein, 10 aa, Homo sapiens
AKHLAAVEER

SEQ ID NO: 23969 - protein, 15 aa, Homo sapiens
MKEEVPTALVEAHVR

SEQ ID NO: 23970 - protein, 10 aa, Homo sapiens
AKHLAAVEER

SEQ ID NO: 23971 - protein, 15 aa, Homo sapiens
MKEEVPTALVEAHVR

SEQ ID NO: 23972 - protein, 10 aa, Homo sapiens
AKHLAAVEER

SEQ ID NO: 23973 - protein, 10 aa, Homo sapiens
AKHLAAVEER

SEQ ID NO: 23974 - protein, 15 aa, Homo sapiens
MKEEVPTALVEAHVR

SEQ ID NO: 23975 - protein, 10 aa, Homo sapiens
AKHLAAVEER

SEQ ID NO: 23976 - protein, 10 aa, Homo sapiens
AKHLAAVEER

SEQ ID NO: 23977 - protein, 15 aa, Homo sapiens
MKEEVPTALVEAHVR

SEQ ID NO: 23978 - protein, 10 aa, Homo sapiens
AKHLAAVEER

SEQ ID NO: 23979 - protein, 10 aa, Homo sapiens
AKHLAAVEER

SEQ ID NO: 23980 - protein, 15 aa, Homo sapiens
MKEEVPTALVEAHVR

SEQ ID NO: 23981 - protein, 15 aa, Homo sapiens
MKEEVPTALVEAHVR

SEQ ID NO: 23982 - protein, 5 aa, Homo sapiens
TKVER

SEQ ID NO: 23983 - protein, 7 aa, Homo sapiens
KVEEAAK

SEQ ID NO: 23984 - protein, 15 aa, Homo sapiens
MKEEVPTALVEAHVR

SEQ ID NO: 23985 - protein, 15 aa, Homo sapiens
MKEEVPTALVEAHVR

SEQ ID NO: 23986 - protein, 15 aa, Homo sapiens
MKEEVPTALVEAHVR

SEQ ID NO: 23987 - protein, 11 aa, Homo sapiens
KVEEAAKVTGK

SEQ ID NO: 23988 - protein, 11 aa, Homo sapiens
KVEEAAKVTGK

SEQ ID NO: 23989 - protein, 11 aa, Homo sapiens
KVEEAAKVTGK

SEQ ID NO: 23990 - protein, 15 aa, Homo sapiens
MKEEVPTALVEAHVR

SEQ ID NO: 23991 - protein, 7 aa, Homo sapiens
KVEEAAK

SEQ ID NO: 23992 - protein, 15 aa, Homo sapiens
MKEEVPTALVEAHVR

SEQ ID NO: 23993 - protein, 11 aa, Homo sapiens
KVEEAAKVTGK

SEQ ID NO: 23994 - protein, 15 aa, Homo sapiens
MKEEVPTALVEAHVR

SEQ ID NO: 23995 - protein, 11 aa, Homo sapiens
KVEEAAKVTGK

SEQ ID NO: 23996 - protein, 16 aa, Homo sapiens
SDGDPIVDPEKEKEPK

SEQ ID NO: 23997 - protein, 16 aa, Homo sapiens
SDGDPIVDPEKEKEPK

SEQ ID NO: 23998 - protein, 13 aa, Homo sapiens
SDGDPIVDPEKEK

SEQ ID NO: 23999 - protein, 17 aa, Homo sapiens
ESEKSDGDPIVDPEKEK

SEQ ID NO: 24000 - protein, 17 aa, Homo sapiens
ESEKSDGDPIVDPEKEK

SEQ ID NO: 24001 - protein, 13 aa, Homo sapiens
SDGDPIVDPEKEK

SEQ ID NO: 24002 - protein, 13 aa, Homo sapiens
SDGDPIVDPEKEK

SEQ ID NO: 24003 - protein, 20 aa, Homo sapiens
EPKEGQEEVLKEVVESEGER

SEQ ID NO: 24004 - protein, 20 aa, Homo sapiens
EPKEGQEEVLKEVVESEGER

SEQ ID NO: 24005 - protein, 20 aa, Homo sapiens
EPKEGQEEVLKEVVESEGER

SEQ ID NO: 24006 - protein, 17 aa, Homo sapiens
ESEKSDGDPIVDPEKEK

SEQ ID NO: 24007 - protein, 13 aa, Homo sapiens
SDGDPIVDPEKEK

SEQ ID NO: 24008 - protein, 20 aa, Homo sapiens
EPKEGQEEVLKEVVESEGER

SEQ ID NO: 24009 - protein, 13 aa, Homo sapiens
SDGDPIVDPEKEK

SEQ ID NO: 24010 - protein, 20 aa, Homo sapiens
EPKEGQEEVLKEVVESEGER

SEQ ID NO: 24011 - protein, 20 aa, Homo sapiens
EPKEGQEEVLKEVVESEGER

SEQ ID NO: 24012 - protein, 20 aa, Homo sapiens
EPKEGQEEVLKEVVESEGER

SEQ ID NO: 24013 - protein, 30 aa, Homo sapiens; identical to SEQ ID NO: 8343

SEQ ID NO: 24014 - protein, 30 aa, Homo sapiens; identical to SEQ ID NO: 8343

SEQ ID NO: 24015 - protein, 30 aa, Homo sapiens; identical to SEQ ID NO: 8343

SEQ ID NO: 24016 - protein, 14 aa, Homo sapiens
TVNTKKDSESAPVK

SEQ ID NO: 24017 - protein, 14 aa, Homo sapiens
TVNTKKDSESAPVK

SEQ ID NO: 24018 - protein, 11 aa, Homo sapiens
TSEAPKKDEEK

SEQ ID NO: 24019 - protein, 11 aa, Homo sapiens
TSEAPKKDEEK

SEQ ID NO: 24020 - protein, 11 aa, Homo sapiens
TSEAPKKDEEK

SEQ ID NO: 24021 - protein, 11 aa, Homo sapiens
TSEAPKKDEEK

SEQ ID NO: 24022 - protein, 19 aa, Homo sapiens
EGGGAIEEEAKEKTSEAPK

SEQ ID NO: 24023 - protein, 8 aa, Homo sapiens
EKTSEAPK

SEQ ID NO: 24024 - protein, 8 aa, Homo sapiens
EKTSEAPK

SEQ ID NO: 24025 - protein, 8 aa, Homo sapiens
EKTSEAPK

SEQ ID NO: 24026 - protein, 8 aa, Homo sapiens
EKTSEAPK

SEQ ID NO: 24027 - protein, 8 aa, Homo sapiens
EKTSEAPK

SEQ ID NO: 24028 - protein, 8 aa, Homo sapiens
EKTSEAPK

SEQ ID NO: 24029 - protein, 9 aa, Homo sapiens
KGPSTPYTK

SEQ ID NO: 24030 - protein, 10 aa, Homo sapiens
AKHLAAVEER

SEQ ID NO: 24031 - protein, 10 aa, Homo sapiens
AKHLAAVEER

SEQ ID NO: 24032 - protein, 7 aa, Homo sapiens
KVEEAAK

SEQ ID NO: 24033 - protein, 13 aa, Homo sapiens
LLHSGMKILSQER

SEQ ID NO: 24034 - protein, 18 aa, Homo sapiens
DRVENEAEKDLQCHAPVR

SEQ ID NO: 24035 - protein, 7 aa, Homo sapiens
KLIDQKK

SEQ ID NO: 24036 - protein, 7 aa, Homo sapiens
KLIDQKK

SEQ ID NO: 24037 - protein, 7 aa, Homo sapiens
KLIDQKK

SEQ ID NO: 24038 - protein, 5 aa, Homo sapiens
NHKYR

SEQ ID NO: 24039 - protein, 6 aa, Homo sapiens
KPVDFK

SEQ ID NO: 24040 - protein, 6 aa, Homo sapiens
KPVDFK

SEQ ID NO: 24041 - protein, 6 aa, Homo sapiens
ILPKLR

SEQ ID NO: 24042 - protein, 5 aa, Homo sapiens
NHKYR

SEQ ID NO: 24043 - protein, 8 aa, Homo sapiens
YKLNVDQK

SEQ ID NO: 24044 - protein, 16 aa, Homo sapiens
VIQAGMFDQKSSSHER

SEQ ID NO: 24045 - protein, 16 aa, Homo sapiens
VIQAGMFDQKSSSHER

SEQ ID NO: 24046 - protein, 8 aa, Homo sapiens
YKLNVDQK

SEQ ID NO: 24047 - protein, 8 aa, Homo sapiens
YKLNVDQK

SEQ ID NO: 24048 - protein, 8 aa, Homo sapiens
YKLNVDQK

SEQ ID NO: 24049 - protein, 8 aa, Homo sapiens
YKLNVDQK

SEQ ID NO: 24050 - protein, 4 aa, Homo sapiens
IKER

SEQ ID NO: 24051 - protein, 6 aa, Homo sapiens
LHKVLR

SEQ ID NO: 24052 - protein, 16 aa, Homo sapiens
GQPLPETLQLAVQGKR

SEQ ID NO: 24053 - protein, 16 aa, Homo sapiens
GQPLPETLQLAVQGKR

SEQ ID NO: 24054 - protein, 13 aa, Homo sapiens
LTCEEEEEKIFGR

SEQ ID NO: 24055 - protein, 13 aa, Homo sapiens
LTCEEEEEKIFGR

SEQ ID NO: 24056 - protein, 16 aa, Homo sapiens
LCTVNSVEEKILAAAK

SEQ ID NO: 24057 - protein, 16 aa, Homo sapiens
LCTVNSVEEKILAAAK

SEQ ID NO: 24058 - protein, 6 aa, Homo sapiens
GSLYKR

SEQ ID NO: 24059 - protein, 6 aa, Homo sapiens
GSLYKR

SEQ ID NO: 24060 - protein, 6 aa, Homo sapiens
GSLYKR

SEQ ID NO: 24061 - protein, 15 aa, Homo sapiens
YKAVSISTEPPTYLR

SEQ ID NO: 24062 - protein, 9 aa, Homo sapiens
IVASSHGKK

SEQ ID NO: 24063 - protein, 6 aa, Homo sapiens
KDGPKR

SEQ ID NO: 24064 - protein, 5 aa, Homo sapiens
KDGPK

SEQ ID NO: 24065 - protein, 5 aa, Homo sapiens
KDGPK

SEQ ID NO: 24066 - protein, 9 aa, Homo sapiens
SKDKAATPR

SEQ ID NO: 24067 - protein, 9 aa, Homo sapiens
SKDKAATPR

SEQ ID NO: 24068 - protein, 9 aa, Homo sapiens
SKDKAATPR

SEQ ID NO: 24069 - protein, 6 aa, Homo sapiens
KDGPKR

SEQ ID NO: 24070 - protein, 7 aa, Homo sapiens
DKAATPR

SEQ ID NO: 24071 - protein, 5 aa, Homo sapiens
KDGPK

SEQ ID NO: 24072 - protein, 7 aa, Homo sapiens
DKAATPR

SEQ ID NO: 24073 - protein, 6 aa, Homo sapiens
KDGPKR

SEQ ID NO: 24074 - protein, 7 aa, Homo sapiens
DKAATPR

SEQ ID NO: 24075 - protein, 6 aa, Homo sapiens
KDGPKR

SEQ ID NO: 24076 - protein, 9 aa, Homo sapiens
SKDKAATPR

SEQ ID NO: 24077 - protein, 9 aa, Homo sapiens
SKDKAATPR

SEQ ID NO: 24078 - protein, 7 aa, Homo sapiens
DKAATPR

SEQ ID NO: 24079 - protein, 9 aa, Homo sapiens
SKDKAATPR

SEQ ID NO: 24080 - protein, 5 aa, Homo sapiens
KDGPK

SEQ ID NO: 24081 - protein, 9 aa, Homo sapiens
SKDKAATPR

SEQ ID NO: 24082 - protein, 9 aa, Homo sapiens
SKDKAATPR

SEQ ID NO: 24083 - protein, 9 aa, Homo sapiens
SKDKAATPR

SEQ ID NO: 24084 - protein, 9 aa, Homo sapiens
SKDKAATPR

SEQ ID NO: 24085 - protein, 11 aa, Homo sapiens
VEASKVPEYIK

SEQ ID NO: 24086 - protein, 5 aa, Homo sapiens
KAAKK

SEQ ID NO: 24087 - protein, 11 aa, Homo sapiens
VEASKVPEYIK

SEQ ID NO: 24088 - protein, 11 aa, Homo sapiens
KAAEFNSNLNR

SEQ ID NO: 24089 - protein, 12 aa, Homo sapiens
VEASKVPEYIKK

SEQ ID NO: 24090 - protein, 12 aa, Homo sapiens
VEASKVPEYIKK

SEQ ID NO: 24091 - protein, 11 aa, Homo sapiens
KAAEFNSNLNR

SEQ ID NO: 24092 - protein, 6 aa, Homo sapiens
KDGPKR

SEQ ID NO: 24093 - protein, 12 aa, Homo sapiens
RSVLSKSVPGYK

SEQ ID NO: 24094 - protein, 13 aa, Homo sapiens
SVLSKSVPGYKPK

SEQ ID NO: 24095 - protein, 10 aa, Homo sapiens
VPEYIKKAAK

SEQ ID NO: 24096 - protein, 10 aa, Homo sapiens
VPEYIKKAAK

SEQ ID NO: 24097 - protein, 8 aa, Homo sapiens
KYPDLERR

SEQ ID NO: 24098 - protein, 7 aa, Homo sapiens
KYPDLER

SEQ ID NO: 24099 - protein, 15 aa, Homo sapiens
SDEVIDLMIKEYPAK

SEQ ID NO: 24100 - protein, 15 aa, Homo sapiens
SDEVIDLMIKEYPAK

SEQ ID NO: 24101 - protein, 15 aa, Homo sapiens
SDEVIDLMIKEYPAK

SEQ ID NO: 24102 - protein, 7 aa, Homo sapiens
KYPDLER

SEQ ID NO: 24103 - protein, 7 aa, Homo sapiens
KYPDLER

SEQ ID NO: 24104 - protein, 15 aa, Homo sapiens
SDEVIDLMIKEYPAK

SEQ ID NO: 24105 - protein, 15 aa, Homo sapiens
SDEVIDLMIKEYPAK

SEQ ID NO: 24106 - protein, 7 aa, Homo sapiens
KYPDLER

SEQ ID NO: 24107 - protein, 7 aa, Homo sapiens
KYPDLER

SEQ ID NO: 24108 - protein, 18 aa, Homo sapiens
EYPAKHAEYSVILQEKER

SEQ ID NO: 24109 - protein, 8 aa, Homo sapiens
RKYPDLER

SEQ ID NO: 24110 - protein, 16 aa, Homo sapiens
EYPAKHAEYSVILQEK

SEQ ID NO: 24111 - protein, 16 aa, Homo sapiens
EYPAKHAEYSVILQEK

SEQ ID NO: 24112 - protein, 7 aa, Homo sapiens
KYPDLER

SEQ ID NO: 24113 - protein, 16 aa, Homo sapiens
EYPAKHAEYSVILQEK

SEQ ID NO: 24114 - protein, 16 aa, Homo sapiens
EYPAKHAEYSVILQEK

SEQ ID NO: 24115 - protein, 16 aa, Homo sapiens
EYPAKHAEYSVILQEK

SEQ ID NO: 24116 - protein, 7 aa, Homo sapiens
KYPDLER

SEQ ID NO: 24117 - protein, 16 aa, Homo sapiens
EYPAKHAEYSVILQEK

SEQ ID NO: 24118 - protein, 16 aa, Homo sapiens
EYPAKHAEYSVILQEK

SEQ ID NO: 24119 - protein, 18 aa, Homo sapiens
EYPAKHAEYSVILQEKER

SEQ ID NO: 24120 - protein, 7 aa, Homo sapiens
KYPDLER

SEQ ID NO: 24121 - protein, 16 aa, Homo sapiens
EYPAKHAEYSVILQEK

SEQ ID NO: 24122 - protein, 16 aa, Homo sapiens
EYPAKHAEYSVILQEK

SEQ ID NO: 24123 - protein, 16 aa, Homo sapiens
EYPAKHAEYSVILQEK

SEQ ID NO: 24124 - protein, 7 aa, Homo sapiens
KYPDLER

SEQ ID NO: 24125 - protein, 8 aa, Homo sapiens
KYPDLERR

SEQ ID NO: 24126 - protein, 8 aa, Homo sapiens
KYPDLERR

SEQ ID NO: 24127 - protein, 8 aa, Homo sapiens
YKVLPTER

SEQ ID NO: 24128 - protein, 21 aa, Homo sapiens
TKVSSYPVALIPGQFQEYYKR

SEQ ID NO: 24129 - protein, 21 aa, Homo sapiens
TKVSSYPVALIPGQFQEYYKR

SEQ ID NO: 24130 - protein, 20 aa, Homo sapiens
TKVSSYPVALIPGQFQEYYK

SEQ ID NO: 24131 - protein, 11 aa, Homo sapiens
SVLSKSVPGYK

SEQ ID NO: 24132 - protein, 4 aa, Homo sapiens
KVGR

SEQ ID NO: 24133 - protein, 15 aa, Homo sapiens
KFLESTDSFNNELKR

SEQ ID NO: 24134 - protein, 15 aa, Homo sapiens
KFLESTDSFNNELKR

SEQ ID NO: 24135 - protein, 15 aa, Homo sapiens
KFLESTDSFNNELKR

SEQ ID NO: 24136 - protein, 15 aa, Homo sapiens
KFLESTDSFNNELKR

SEQ ID NO: 24137 - protein, 15 aa, Homo sapiens
KFLESTDSFNNELKR

SEQ ID NO: 24138 - protein, 12 aa, Homo sapiens
LCGLKVEVDMEK

SEQ ID NO: 24139 - protein, 12 aa, Homo sapiens
LCGLKVEVDMEK

SEQ ID NO: 24140 - protein, 12 aa, Homo sapiens
LCGLKVEVDMEK

SEQ ID NO: 24141 - protein, 12 aa, Homo sapiens
LCGLKVEVDMEK

SEQ ID NO: 24142 - protein, 10 aa, Homo sapiens
EKEAAEQAER

SEQ ID NO: 24143 - protein, 14 aa, Homo sapiens
VTASSGITIPKPPK

SEQ ID NO: 24144 - protein, 14 aa, Homo sapiens
VTASSGITIPKPPK

SEQ ID NO: 24145 - protein, 14 aa, Homo sapiens
VTASSGITIPKPPK

SEQ ID NO: 24146 - protein, 14 aa, Homo sapiens
VTASSGITIPKPPK

SEQ ID NO: 24147 - protein, 14 aa, Homo sapiens
VTASSGITIPKPPK

SEQ ID NO: 24148 - protein, 14 aa, Homo sapiens
VTASSGITIPKPPK

SEQ ID NO: 24149 - protein, 14 aa, Homo sapiens
VTASSGITIPKPPK

SEQ ID NO: 24150 - protein, 14 aa, Homo sapiens
VTASSGITIPKPPK

SEQ ID NO: 24151 - protein, 14 aa, Homo sapiens
VTASSGITIPKPPK

SEQ ID NO: 24152 - protein, 14 aa, Homo sapiens
VTASSGITIPKPPK

SEQ ID NO: 24153 - protein, 14 aa, Homo sapiens
VTASSGITIPKPPK

SEQ ID NO: 24154 - protein, 10 aa, Homo sapiens
AKHLAAVEER

SEQ ID NO: 24155 - protein, 10 aa, Homo sapiens
AKHLAAVEER

SEQ ID NO: 24156 - protein, 34 aa, Homo sapiens; identical to SEQ ID NO: 8864

SEQ ID NO: 24157 - protein, 16 aa, Homo sapiens
VREEVPLELVEAHVKK

SEQ ID NO: 24158 - protein, 16 aa, Homo sapiens
VREEVPLELVEAHVKK

SEQ ID NO: 24159 - protein, 15 aa, Homo sapiens
VASAAAKAALEEFSR

SEQ ID NO: 24160 - protein, 10 aa, Homo sapiens
AKHLAAVEER

SEQ ID NO: 24161 - protein, 10 aa, Homo sapiens
AKHLAAVEER

SEQ ID NO: 24162 - protein, 15 aa, Homo sapiens
VASAAAKAALEEFSR

SEQ ID NO: 24163 - protein, 15 aa, Homo sapiens
VASAAAKAALEEFSR

SEQ ID NO: 24164 - protein, 15 aa, Homo sapiens
VASAAAKAALEEFSR

SEQ ID NO: 24165 - protein, 7 aa, Homo sapiens
KASANAR

SEQ ID NO: 24166 - protein, 14 aa, Homo sapiens
ISTKNEEPVRSPER

SEQ ID NO: 24167 - protein, 14 aa, Homo sapiens
ISTKNEEPVRSPER

SEQ ID NO: 24168 - protein, 10 aa, Homo sapiens
ISTKNEEPVR

SEQ ID NO: 24169 - protein, 9 aa, Homo sapiens
DRKASANAR

SEQ ID NO: 24170 - protein, 8 aa, Homo sapiens
SKGASAGR

SEQ ID NO: 24171 - protein, 9 aa, Homo sapiens
KGQASLYGK

SEQ ID NO: 24172 - protein, 5 aa, Homo sapiens
KKSGK

SEQ ID NO: 24173 - protein, 9 aa, Homo sapiens
KGQASLYGK

SEQ ID NO: 24174 - protein, 5 aa, Homo sapiens
KKSGK

SEQ ID NO: 24175 - protein, 9 aa, Homo sapiens
KGQASLYGK

SEQ ID NO: 24176 - protein, 9 aa, Homo sapiens
KGQASLYGK

SEQ ID NO: 24177 - protein, 9 aa, Homo sapiens
KGQASLYGK

SEQ ID NO: 24178 - protein, 12 aa, Homo sapiens
EKPVDLQNFGLR

SEQ ID NO: 24179 - protein, 12 aa, Homo sapiens
EKPVDLQNFGLR

SEQ ID NO: 24180 - protein, 12 aa, Homo sapiens
EKPVDLQNFGLR

SEQ ID NO: 24181 - protein, 18 aa, Homo sapiens
SPQVPAAQQMLNFPEKNK

SEQ ID NO: 24182 - protein, 12 aa, Homo sapiens
EKPVDLQNFGLR

SEQ ID NO: 24183 - protein, 12 aa, Homo sapiens
EKPVDLQNFGLR

SEQ ID NO: 24184 - protein, 18 aa, Homo sapiens
SPQVPAAQQMLNFPEKNK

SEQ ID NO: 24185 - protein, 18 aa, Homo sapiens
SPQVPAAQQMLNFPEKNK

SEQ ID NO: 24186 - protein, 12 aa, Homo sapiens
EKPVDLQNFGLR

SEQ ID NO: 24187 - protein, 18 aa, Homo sapiens
SPQVPAAQQMLNFPEKNK

SEQ ID NO: 24188 - protein, 18 aa, Homo sapiens
SPQVPAAQQMLNFPEKNK

SEQ ID NO: 24189 - protein, 5 aa, Homo sapiens
KKSGK

SEQ ID NO: 24190 - protein, 5 aa, Homo sapiens
KKSGK

SEQ ID NO: 24191 - protein, 10 aa, Homo sapiens
KGQASLYGKR

SEQ ID NO: 24192 - protein, 10 aa, Homo sapiens
KGQASLYGKR

SEQ ID NO: 24193 - protein, 10 aa, Homo sapiens
KGQASLYGKR

SEQ ID NO: 24194 - protein, 12 aa, Homo sapiens
RALPEFFNGKNK

SEQ ID NO: 24195 - protein, 11 aa, Homo sapiens
SKTPEIYLAYR

SEQ ID NO: 24196 - protein, 12 aa, Homo sapiens
EKPVDLQNFGLR

SEQ ID NO: 24197 - protein, 34 aa, Homo sapiens; identical to SEQ ID NO: 8864

SEQ ID NO: 24198 - protein, 34 aa, Homo sapiens; identical to SEQ ID NO: 8864

SEQ ID NO: 24199 - protein, 7 aa, Homo sapiens
KVQEAAR

SEQ ID NO: 24200 - protein, 7 aa, Homo sapiens
KVQEAAR

SEQ ID NO: 24201 - protein, 7 aa, Homo sapiens
KVQEAAR

SEQ ID NO: 24202 - protein, 7 aa, Homo sapiens
KVQEAAR

SEQ ID NO: 24203 - protein, 7 aa, Homo sapiens
TDIYSKK

SEQ ID NO: 24204 - protein, 7 aa, Homo sapiens
TDIYSKK

SEQ ID NO: 24205 - protein, 7 aa, Homo sapiens
TDIYSKK

SEQ ID NO: 24206 - protein, 8 aa, Homo sapiens
SKGASAGR

SEQ ID NO: 24207 - protein, 7 aa, Homo sapiens
TDIYSKK

SEQ ID NO: 24208 - protein, 8 aa, Homo sapiens
SKGASAGR

SEQ ID NO: 24209 - protein, 8 aa, Homo sapiens
SKGASAGR

SEQ ID NO: 24210 - protein, 16 aa, Homo sapiens
MQKEITALAPSTMKIK

SEQ ID NO: 24211 - protein, 13 aa, Homo sapiens
EITALAPSTMKIK

SEQ ID NO: 24212 - protein, 13 aa, Homo sapiens
EITALAPSTMKIK

SEQ ID NO: 24213 - protein, 13 aa, Homo sapiens
EITALAPSTMKIK

SEQ ID NO: 24214 - protein, 16 aa, Homo sapiens
MQKEITALAPSTMKIK

SEQ ID NO: 24215 - protein, 13 aa, Homo sapiens
EITALAPSTMKIK

SEQ ID NO: 24216 - protein, 22 aa, Homo sapiens
KDLYANTVLSGGTTMYPGIADR

SEQ ID NO: 24217 - protein, 22 aa, Homo sapiens
KDLYANTVLSGGTTMYPGIADR

SEQ ID NO: 24218 - protein, 13 aa, Homo sapiens
EITALAPSTMKIK

SEQ ID NO: 24219 - protein, 13 aa, Homo sapiens
EITALAPSTMKIK

SEQ ID NO: 24220 - protein, 20 aa, Homo sapiens
EITALAPSTMKIKIIAPPER

SEQ ID NO: 24221 - protein, 13 aa, Homo sapiens
EITALAPSTMKIK

SEQ ID NO: 24222 - protein, 10 aa, Homo sapiens
IKIIAPPERK

SEQ ID NO: 24223 - protein, 9 aa, Homo sapiens
IKIIAPPER

SEQ ID NO: 24224 - protein, 9 aa, Homo sapiens
IKIIAPPER

SEQ ID NO: 24225 - protein, 9 aa, Homo sapiens
IKIIAPPER

SEQ ID NO: 24226 - protein, 10 aa, Homo sapiens
IKIIAPPERK

SEQ ID NO: 24227 - protein, 10 aa, Homo sapiens
IKIIAPPERK

SEQ ID NO: 24228 - protein, 10 aa, Homo sapiens
IKIIAPPERK

SEQ ID NO: 24229 - protein, 9 aa, Homo sapiens
IKIIAPPER

SEQ ID NO: 24230 - protein, 9 aa, Homo sapiens
IKIIAPPER

SEQ ID NO: 24231 - protein, 10 aa, Homo sapiens
IKIIAPPERK

SEQ ID NO: 24232 - protein, 9 aa, Homo sapiens
IKIIAPPER

SEQ ID NO: 24233 - protein, 9 aa, Homo sapiens
IKIIAPPER

SEQ ID NO: 24234 - protein, 9 aa, Homo sapiens
IKIIAPPER

SEQ ID NO: 24235 - protein, 9 aa, Homo sapiens
IKIIAPPER

SEQ ID NO: 24236 - protein, 13 aa, Homo sapiens
DLTDYLMKILTER

SEQ ID NO: 24237 - protein, 3 aa, Homo sapiens
KCF

SEQ ID NO: 24238 - protein, 3 aa, Homo sapiens
KCF

SEQ ID NO: 24239 - protein, 3 aa, Homo sapiens
KCF

SEQ ID NO: 24240 - protein, 3 aa, Homo sapiens
KCF

SEQ ID NO: 24241 - protein, 3 aa, Homo sapiens
KCF

SEQ ID NO: 24242 - protein, 21 aa, Homo sapiens
VAPEEHPVLLTEAPLNPKANR

SEQ ID NO: 24243 - protein, 9 aa, Homo sapiens
IKIIAPPER

SEQ ID NO: 24244 - protein, 20 aa, Homo sapiens
EITALAPSTMKIKIIAPPER

SEQ ID NO: 24245 - protein, 11 aa, Homo sapiens
EPIDLKTIAQR

SEQ ID NO: 24246 - protein, 10 aa, Homo sapiens
AAKVAEQQER

SEQ ID NO: 24247 - protein, 13 aa, Homo sapiens
NLETAKKAEYEER

SEQ ID NO: 24248 - protein, 13 aa, Homo sapiens
NLETAKKAEYEER

SEQ ID NO: 24249 - protein, 13 aa, Homo sapiens
NLETAKKAEYEER

SEQ ID NO: 24250 - protein, 10 aa, Homo sapiens
AAKVAEQQER

SEQ ID NO: 24251 - protein, 13 aa, Homo sapiens
NLETAKKAEYEER

SEQ ID NO: 24252 - protein, 12 aa, Homo sapiens
AAKVAEQQERER

SEQ ID NO: 24253 - protein, 12 aa, Homo sapiens
AAKVAEQQERER

SEQ ID NO: 24254 - protein, 18 aa, Homo sapiens
NNQGQLIAEPFYHLPSKK

SEQ ID NO: 24255 - protein, 18 aa, Homo sapiens
NNQGQLIAEPFYHLPSKK

SEQ ID NO: 24256 - protein, 18 aa, Homo sapiens
NNQGQLIAEPFYHLPSKK

SEQ ID NO: 24257 - protein, 15 aa, Homo sapiens
KINMSGYILFSSEMR

SEQ ID NO: 24258 - protein, 15 aa, Homo sapiens
KINMSGYILFSSEMR

SEQ ID NO: 24259 - protein, 15 aa, Homo sapiens
KINMSGYILFSSEMR

SEQ ID NO: 24260 - protein, 15 aa, Homo sapiens
KINMSGYILFSSEMR

SEQ ID NO: 24261 - protein, 9 aa, Homo sapiens
EIEEDKLKR

SEQ ID NO: 24262 - protein, 9 aa, Homo sapiens
EIEEDKLKR

SEQ ID NO: 24263 - protein, 9 aa, Homo sapiens
EIEEDKLKR

SEQ ID NO: 24264 - protein, 9 aa, Homo sapiens
EIEEDKLKR

SEQ ID NO: 24265 - protein, 9 aa, Homo sapiens
EIEEDKLKR

SEQ ID NO: 24266 - protein, 9 aa, Homo sapiens
EIEEDKLKR

SEQ ID NO: 24267 - protein, 9 aa, Homo sapiens
EIEEDKLKR

SEQ ID NO: 24268 - protein, 15 aa, Homo sapiens
LNEVYEAVKNYTDKR

SEQ ID NO: 24269 - protein, 5 aa, Homo sapiens
LKLSR

SEQ ID NO: 24270 - protein, 5 aa, Homo sapiens
LKLSR

SEQ ID NO: 24271 - protein, 17 aa, Homo sapiens
RKELGPLPDDDDMASPK

SEQ ID NO: 24272 - protein, 17 aa, Homo sapiens
RKELGPLPDDDDMASPK

SEQ ID NO: 24273 - protein, 6 aa, Homo sapiens
LLKEKR

SEQ ID NO: 24274 - protein, 17 aa, Homo sapiens
RKELGPLPDDDDMASPK

SEQ ID NO: 24275 - protein, 7 aa, Homo sapiens
KSGISPK

SEQ ID NO: 24276 - protein, 8 aa, Homo sapiens
KSGISPKK

SEQ ID NO: 24277 - protein, 7 aa, Homo sapiens
KSGISPK

SEQ ID NO: 24278 - protein, 5 aa, Homo sapiens
KELAR

SEQ ID NO: 24279 - protein, 5 aa, Homo sapiens
KELAR

SEQ ID NO: 24280 - protein, 5 aa, Homo sapiens
KELAR

SEQ ID NO: 24281 - protein, 23 aa, Homo sapiens
RDDIEDGDSMISSATSDTGSAKR

SEQ ID NO: 24282 - protein, 23 aa, Homo sapiens
RDDIEDGDSMISSATSDTGSAKR

SEQ ID NO: 24283 - protein, 23 aa, Homo sapiens
RDDIEDGDSMISSATSDTGSAKR

SEQ ID NO: 24284 - protein, 6 aa, Homo sapiens
KKELAR

SEQ ID NO: 24285 - protein, 15 aa, Homo sapiens
KPIVPQKEPSPLLEK

SEQ ID NO: 24286 - protein, 5 aa, Homo sapiens
LKLSR

SEQ ID NO: 24287 - protein, 15 aa, Homo sapiens
KPIVPQKEPSPLLEK

SEQ ID NO: 24288 - protein, 15 aa, Homo sapiens
KPIVPQKEPSPLLEK

SEQ ID NO: 24289 - protein, 21 aa, Homo sapiens
NQPDYYEVVSQPIDLMKIQQK

SEQ ID NO: 24290 - protein, 21 aa, Homo sapiens
NQPDYYEVVSQPIDLMKIQQK

SEQ ID NO: 24291 - protein, 9 aa, Homo sapiens
EIEEDKLKR

SEQ ID NO: 24292 - protein, 9 aa, Homo sapiens
EIEEDKLKR

SEQ ID NO: 24293 - protein, 12 aa, Homo sapiens
RYNVPNSAIYKR

SEQ ID NO: 24294 - protein, 11 aa, Homo sapiens
VLKLQQVMQAK

SEQ ID NO: 24295 - protein, 11 aa, Homo sapiens
VLKLQQVMQAK

SEQ ID NO: 24296 - protein, 11 aa, Homo sapiens
VLKLQQVMQAK

SEQ ID NO: 24297 - protein, 11 aa, Homo sapiens
YNVPNSAIYKR

SEQ ID NO: 24298 - protein, 12 aa, Homo sapiens
RYNVPNSAIYKR

SEQ ID NO: 24299 - protein, 11 aa, Homo sapiens
VLKLQQVMQAK

SEQ ID NO: 24300 - protein, 11 aa, Homo sapiens
VLKLQQVMQAK

SEQ ID NO: 24301 - protein, 11 aa, Homo sapiens
VLKLQQVMQAK

SEQ ID NO: 24302 - protein, 11 aa, Homo sapiens
YNVPNSAIYKR

SEQ ID NO: 24303 - protein, 12 aa, Homo sapiens
RYNVPNSAIYKR

SEQ ID NO: 24304 - protein, 11 aa, Homo sapiens
VLKLQQVMQAK

SEQ ID NO: 24305 - protein, 12 aa, Homo sapiens
RYNVPNSAIYKR

SEQ ID NO: 24306 - protein, 11 aa, Homo sapiens
VLKLQQVMQAK

SEQ ID NO: 24307 - protein, 12 aa, Homo sapiens
RYNVPNSAIYKR

SEQ ID NO: 24308 - protein, 11 aa, Homo sapiens
YNVPNSAIYKR

SEQ ID NO: 24309 - protein, 11 aa, Homo sapiens
YNVPNSAIYKR

SEQ ID NO: 24310 - protein, 11 aa, Homo sapiens
YNVPNSAIYKR

SEQ ID NO: 24311 - protein, 12 aa, Homo sapiens
RYNVPNSAIYKR

SEQ ID NO: 24312 - protein, 11 aa, Homo sapiens
VLKLQQVMQAK

SEQ ID NO: 24313 - protein, 11 aa, Homo sapiens
VLKLQQVMQAK

SEQ ID NO: 24314 - protein, 11 aa, Homo sapiens
VLKLQQVMQAK

SEQ ID NO: 24315 - protein, 12 aa, Homo sapiens
RYNVPNSAIYKR

SEQ ID NO: 24316 - protein, 11 aa, Homo sapiens
VLKLQQVMQAK

SEQ ID NO: 24317 - protein, 11 aa, Homo sapiens
YNVPNSAIYKR

SEQ ID NO: 24318 - protein, 11 aa, Homo sapiens
YNVPNSAIYKR

SEQ ID NO: 24319 - protein, 11 aa, Homo sapiens
VLKLQQVMQAK

SEQ ID NO: 24320 - protein, 12 aa, Homo sapiens
RYNVPNSAIYKR

SEQ ID NO: 24321 - protein, 11 aa, Homo sapiens
YNVPNSAIYKR

SEQ ID NO: 24322 - protein, 11 aa, Homo sapiens
YNVPNSAIYKR

SEQ ID NO: 24323 - protein, 11 aa, Homo sapiens
VLKLQQVMQAK

SEQ ID NO: 24324 - protein, 11 aa, Homo sapiens
VLKLQQVMQAK

SEQ ID NO: 24325 - protein, 11 aa, Homo sapiens
VLKLQQVMQAK

SEQ ID NO: 24326 - protein, 11 aa, Homo sapiens
VLKLQQVMQAK

SEQ ID NO: 24327 - protein, 11 aa, Homo sapiens
VLKLQQVMQAK

SEQ ID NO: 24328 - protein, 11 aa, Homo sapiens
VLKLQQVMQAK

SEQ ID NO: 24329 - protein, 11 aa, Homo sapiens
VLKLQQVMQAK

SEQ ID NO: 24330 - protein, 11 aa, Homo sapiens
VLKLQQVMQAK

SEQ ID NO: 24331 - protein, 11 aa, Homo sapiens
YNVPNSAIYKR

SEQ ID NO: 24332 - protein, 11 aa, Homo sapiens
YNVPNSAIYKR

SEQ ID NO: 24333 - protein, 6 aa, Homo sapiens
YSAKTK

SEQ ID NO: 24334 - protein, 19 aa, Homo sapiens
EAEKSEDSSGAAGLSGLHR

SEQ ID NO: 24335 - protein, 19 aa, Homo sapiens
EAEKSEDSSGAAGLSGLHR

SEQ ID NO: 24336 - protein, 5 aa, Homo sapiens
EKLPK

SEQ ID NO: 24337 - protein, 10 aa, Homo sapiens
HLHNDVEKER

SEQ ID NO: 24338 - protein, 6 aa, Homo sapiens
FKGLKR

SEQ ID NO: 24339 - protein, 6 aa, Homo sapiens
FKGLKR

SEQ ID NO: 24340 - protein, 10 aa, Homo sapiens
YNESDKQMKK

SEQ ID NO: 24341 - protein, 10 aa, Homo sapiens
YNESDKQMKK

SEQ ID NO: 24342 - protein, 10 aa, Homo sapiens
YNESDKQMKK

SEQ ID NO: 24343 - protein, 6 aa, Homo sapiens
FKGLKR

SEQ ID NO: 24344 - protein, 6 aa, Homo sapiens
FKGLKR

SEQ ID NO: 24345 - protein, 10 aa, Homo sapiens
YNESDKQMKK

SEQ ID NO: 24346 - protein, 6 aa, Homo sapiens
FKGLKR

SEQ ID NO: 24347 - protein, 6 aa, Homo sapiens
FKGLKR

SEQ ID NO: 24348 - protein, 6 aa, Homo sapiens
FKGLKR

SEQ ID NO: 24349 - protein, 6 aa, Homo sapiens
FKGLKR

SEQ ID NO: 24350 - protein, 6 aa, Homo sapiens
FKGLKR

SEQ ID NO: 24351 - protein, 6 aa, Homo sapiens
FKGLKR

SEQ ID NO: 24352 - protein, 10 aa, Homo sapiens
YNESDKQMKK

SEQ ID NO: 24353 - protein, 10 aa, Homo sapiens
YNESDKQMKK

SEQ ID NO: 24354 - protein, 6 aa, Homo sapiens
FKGLKR

SEQ ID NO: 24355 - protein, 10 aa, Homo sapiens
YNESDKQMKK

SEQ ID NO: 24356 - protein, 10 aa, Homo sapiens
YNESDKQMKK

SEQ ID NO: 24357 - protein, 10 aa, Homo sapiens
YNESDKQMKK

SEQ ID NO: 24358 - protein, 10 aa, Homo sapiens
YNESDKQMKK

SEQ ID NO: 24359 - protein, 10 aa, Homo sapiens
YNESDKQMKK

SEQ ID NO: 24360 - protein, 10 aa, Homo sapiens
YNESDKQMKK

SEQ ID NO: 24361 - protein, 8 aa, Homo sapiens
NPTSKYYR

SEQ ID NO: 24362 - protein, 8 aa, Homo sapiens
NPTSKYYR

SEQ ID NO: 24363 - protein, 5 aa, Homo sapiens
LKLSR

SEQ ID NO: 24364 - protein, 8 aa, Homo sapiens
NPTSKYYR

SEQ ID NO: 24365 - protein, 22 aa, Homo sapiens
VQYPDYYAIIKEPIDLKTIAQR

SEQ ID NO: 24366 - protein, 22 aa, Homo sapiens
VQYPDYYAIIKEPIDLKTIAQR

SEQ ID NO: 24367 - protein, 22 aa, Homo sapiens
VQYPDYYAIIKEPIDLKTIAQR

SEQ ID NO: 24368 - protein, 22 aa, Homo sapiens
VQYPDYYAIIKEPIDLKTIAQR

SEQ ID NO: 24369 - protein, 22 aa, Homo sapiens
VQYPDYYAIIKEPIDLKTIAQR

SEQ ID NO: 24370 - protein, 22 aa, Homo sapiens
VQYPDYYAIIKEPIDLKTIAQR

SEQ ID NO: 24371 - protein, 22 aa, Homo sapiens
VQYPDYYAIIKEPIDLKTIAQR

SEQ ID NO: 24372 - protein, 22 aa, Homo sapiens
VQYPDYYAIIKEPIDLKTIAQR

SEQ ID NO: 24373 - protein, 22 aa, Homo sapiens
VQYPDYYAIIKEPIDLKTIAQR

SEQ ID NO: 24374 - protein, 22 aa, Homo sapiens
VQYPDYYAIIKEPIDLKTIAQR

SEQ ID NO: 24375 - protein, 12 aa, Homo sapiens
LISELFQKLPSK

SEQ ID NO: 24376 - protein, 22 aa, Homo sapiens
VQYPDYYAIIKEPIDLKTIAQR

SEQ ID NO: 24377 - protein, 12 aa, Homo sapiens
LISELFQKLPSK

SEQ ID NO: 24378 - protein, 22 aa, Homo sapiens
VQYPDYYAIIKEPIDLKTIAQR

SEQ ID NO: 24379 - protein, 22 aa, Homo sapiens
VQYPDYYAIIKEPIDLKTIAQR

SEQ ID NO: 24380 - protein, 12 aa, Homo sapiens
LISELFQKLPSK

SEQ ID NO: 24381 - protein, 10 aa, Homo sapiens
AAKVAEQQER

SEQ ID NO: 24382 - protein, 10 aa, Homo sapiens
AAKVAEQQER

SEQ ID NO: 24383 - protein, 5 aa, Homo sapiens
LKLSR

SEQ ID NO: 24384 - protein, 16 aa, Homo sapiens
KELGPLPDDDDMASPK

SEQ ID NO: 24385 - protein, 18 aa, Homo sapiens
KELGPLPDDDDMASPKLK

SEQ ID NO: 24386 - protein, 19 aa, Homo sapiens
EAEKSEDSSGAAGLSGLHR

SEQ ID NO: 24387 - protein, 19 aa, Homo sapiens
EAEKSEDSSGAAGLSGLHR

SEQ ID NO: 24388 - protein, 20 aa, Homo sapiens
REAEKSEDSSGAAGLSGLHR

SEQ ID NO: 24389 - protein, 6 aa, Homo sapiens
IFYMKK

SEQ ID NO: 24390 - protein, 6 aa, Homo sapiens
KFKGLK

SEQ ID NO: 24391 - protein, 6 aa, Homo sapiens
FKGLKR

SEQ ID NO: 24392 - protein, 6 aa, Homo sapiens
FKGLKR

SEQ ID NO: 24393 - protein, 3 aa, Homo sapiens
KFK

SEQ ID NO: 24394 - protein, 3 aa, Homo sapiens
KFK

SEQ ID NO: 24395 - protein, 8 aa, Homo sapiens
KIQLLEAK

SEQ ID NO: 24396 - protein, 6 aa, Homo sapiens
KKELAR

SEQ ID NO: 24397 - protein, 6 aa, Homo sapiens
KKELAR

SEQ ID NO: 24398 - protein, 19 aa, Homo sapiens
EAEKSEDSSGAAGLSGLHR

SEQ ID NO: 24399 - protein, 19 aa, Homo sapiens
EAEKSEDSSGAAGLSGLHR

SEQ ID NO: 24400 - protein, 10 aa, Homo sapiens
AAKVAEQQER

SEQ ID NO: 24401 - protein, 12 aa, Homo sapiens
AAKVAEQQERER

SEQ ID NO: 24402 - protein, 7 aa, Homo sapiens
KAEYEER

SEQ ID NO: 24403 - protein, 10 aa, Homo sapiens
AAKVAEQQER

SEQ ID NO: 24404 - protein, 12 aa, Homo sapiens
AAKVAEQQERER

SEQ ID NO: 24405 - protein, 7 aa, Homo sapiens
SAKGSAK

SEQ ID NO: 24406 - protein, 7 aa, Homo sapiens
SAKGSAK

SEQ ID NO: 24407 - protein, 5 aa, Homo sapiens
EEEKR

SEQ ID NO: 24408 - protein, 19 aa, Homo sapiens
EAEKSEDSSGAAGLSGLHR

SEQ ID NO: 24409 - protein, 19 aa, Homo sapiens
EAEKSEDSSGAAGLSGLHR

SEQ ID NO: 24410 - protein, 19 aa, Homo sapiens
EAEKSEDSSGAAGLSGLHR

SEQ ID NO: 24411 - protein, 19 aa, Homo sapiens
EAEKSEDSSGAAGLSGLHR

SEQ ID NO: 24412 - protein, 19 aa, Homo sapiens
EAEKSEDSSGAAGLSGLHR

SEQ ID NO: 24413 - protein, 19 aa, Homo sapiens
EAEKSEDSSGAAGLSGLHR

SEQ ID NO: 24414 - protein, 19 aa, Homo sapiens
EAEKSEDSSGAAGLSGLHR

SEQ ID NO: 24415 - protein, 23 aa, Homo sapiens
RDDIEDGDSMISSATSDTGSAKR

SEQ ID NO: 24416 - protein, 23 aa, Homo sapiens
RDDIEDGDSMISSATSDTGSAKR

SEQ ID NO: 24417 - protein, 23 aa, Homo sapiens
RDDIEDGDSMISSATSDTGSAKR

SEQ ID NO: 24418 - protein, 11 aa, Homo sapiens
DVHLSKEQESR

SEQ ID NO: 24419 - protein, 11 aa, Homo sapiens
DVHLSKEQESR

SEQ ID NO: 24420 - protein, 11 aa, Homo sapiens
DVHLSKEQESR

SEQ ID NO: 24421 - protein, 15 aa, Homo sapiens
LTGPSHSKGSLGEER

SEQ ID NO: 24422 - protein, 11 aa, Homo sapiens
YNVPNSAIYKR

SEQ ID NO: 24423 - protein, 15 aa, Homo sapiens
LTGPSHSKGSLGEER

SEQ ID NO: 24424 - protein, 8 aa, Homo sapiens
NPTSKYYR

SEQ ID NO: 24425 - protein, 8 aa, Homo sapiens
NPTSKYYR

SEQ ID NO: 24426 - protein, 15 aa, Homo sapiens
LTGPSHSKGSLGEER

SEQ ID NO: 24427 - protein, 15 aa, Homo sapiens
LTGPSHSKGSLGEER

SEQ ID NO: 24428 - protein, 15 aa, Homo sapiens
LTGPSHSKGSLGEER

SEQ ID NO: 24429 - protein, 8 aa, Homo sapiens
NPTSKYYR

SEQ ID NO: 24430 - protein, 15 aa, Homo sapiens
LTGPSHSKGSLGEER

SEQ ID NO: 24431 - protein, 8 aa, Homo sapiens
NPTSKYYR

SEQ ID NO: 24432 - protein, 8 aa, Homo sapiens
NPTSKYYR

SEQ ID NO: 24433 - protein, 8 aa, Homo sapiens
NPTSKYYR

SEQ ID NO: 24434 - protein, 8 aa, Homo sapiens
NPTSKYYR

SEQ ID NO: 24435 - protein, 11 aa, Homo sapiens
VLKLQQVMQAK

SEQ ID NO: 24436 - protein, 15 aa, Homo sapiens
LTGPSHSKGSLGEER

SEQ ID NO: 24437 - protein, 5 aa, Homo sapiens
LKLSR

SEQ ID NO: 24438 - protein, 11 aa, Homo sapiens
VLKLQQVMQAK

SEQ ID NO: 24439 - protein, 11 aa, Homo sapiens
VLKLQQVMQAK

SEQ ID NO: 24440 - protein, 6 aa, Homo sapiens
KKELAR

SEQ ID NO: 24441 - protein, 7 aa, Homo sapiens
KSGISPK

SEQ ID NO: 24442 - protein, 11 aa, Homo sapiens
VLKLQQVMQAK

SEQ ID NO: 24443 - protein, 11 aa, Homo sapiens
VLKLQQVMQAK

SEQ ID NO: 24444 - protein, 11 aa, Homo sapiens
VLKLQQVMQAK

SEQ ID NO: 24445 - protein, 11 aa, Homo sapiens
VLKLQQVMQAK

SEQ ID NO: 24446 - protein, 11 aa, Homo sapiens
VLKLQQVMQAK

SEQ ID NO: 24447 - protein, 5 aa, Homo sapiens
KELAR

SEQ ID NO: 24448 - protein, 5 aa, Homo sapiens
KELAR

SEQ ID NO: 24449 - protein, 11 aa, Homo sapiens
VLKLQQVMQAK

SEQ ID NO: 24450 - protein, 6 aa, Homo sapiens
KKELAR

SEQ ID NO: 24451 - protein, 6 aa, Homo sapiens
KKELAR

SEQ ID NO: 24452 - protein, 12 aa, Homo sapiens
RVLKLQQVMQAK

SEQ ID NO: 24453 - protein, 11 aa, Homo sapiens
VLKLQQVMQAK

SEQ ID NO: 24454 - protein, 17 aa, Homo sapiens
AVIKAQHPDYSFGELSR

SEQ ID NO: 24455 - protein, 17 aa, Homo sapiens
AVIKAQHPDYSFGELSR

SEQ ID NO: 24456 - protein, 17 aa, Homo sapiens
AVIKAQHPDYSFGELSR

SEQ ID NO: 24457 - protein, 17 aa, Homo sapiens
AVIKAQHPDYSFGELSR

SEQ ID NO: 24458 - protein, 17 aa, Homo sapiens
AVIKAQHPDYSFGELSR

SEQ ID NO: 24459 - protein, 7 aa, Homo sapiens
NLETAKK

SEQ ID NO: 24460 - protein, 17 aa, Homo sapiens
AVIKAQHPDYSFGELSR

SEQ ID NO: 24461 - protein, 17 aa, Homo sapiens
AVIKAQHPDYSFGELSR

SEQ ID NO: 24462 - protein, 17 aa, Homo sapiens
AVIKAQHPDYSFGELSR

SEQ ID NO: 24463 - protein, 17 aa, Homo sapiens
AVIKAQHPDYSFGELSR

SEQ ID NO: 24464 - protein, 17 aa, Homo sapiens
AVIKAQHPDYSFGELSR

SEQ ID NO: 24465 - protein, 17 aa, Homo sapiens
AVIKAQHPDYSFGELSR

SEQ ID NO: 24466 - protein, 12 aa, Homo sapiens
LCDLFMVKPSKK

SEQ ID NO: 24467 - protein, 11 aa, Homo sapiens
LCDLFMVKPSK

SEQ ID NO: 24468 - protein, 8 aa, Homo sapiens
KDYPDYYK

SEQ ID NO: 24469 - protein, 8 aa, Homo sapiens
KDYPDYYK

SEQ ID NO: 24470 - protein, 11 aa, Homo sapiens
LCDLFMVKPSK

SEQ ID NO: 24471 - protein, 11 aa, Homo sapiens
LCDLFMVKPSK

SEQ ID NO: 24472 - protein, 8 aa, Homo sapiens
KDYPDYYK

SEQ ID NO: 24473 - protein, 8 aa, Homo sapiens
KDYPDYYK

SEQ ID NO: 24474 - protein, 8 aa, Homo sapiens
KDYPDYYK

SEQ ID NO: 24475 - protein, 11 aa, Homo sapiens
LCDLFMVKPSK

SEQ ID NO: 24476 - protein, 8 aa, Homo sapiens
KDYPDYYK

SEQ ID NO: 24477 - protein, 8 aa, Homo sapiens
KDYPDYYK

SEQ ID NO: 24478 - protein, 11 aa, Homo sapiens
LCDLFMVKPSK

SEQ ID NO: 24479 - protein, 11 aa, Homo sapiens
LCDLFMVKPSK

SEQ ID NO: 24480 - protein, 8 aa, Homo sapiens
KDYPDYYK

SEQ ID NO: 24481 - protein, 8 aa, Homo sapiens
KIQLLEAK

SEQ ID NO: 24482 - protein, 8 aa, Homo sapiens
KIQLLEAK

SEQ ID NO: 24483 - protein, 10 aa, Homo sapiens
LDGTTKAEDR

SEQ ID NO: 24484 - protein, 16 aa, Homo sapiens
KRDSDAGSSTPTTSTR

SEQ ID NO: 24485 - protein, 10 aa, Homo sapiens
VSYKGSPAAR

SEQ ID NO: 24486 - protein, 10 aa, Homo sapiens
VSYKGSPAAR

SEQ ID NO: 24487 - protein, 15 aa, Homo sapiens
DTALETALNAKAYKR

SEQ ID NO: 24488 - protein, 15 aa, Homo sapiens
DTALETALNAKAYKR

SEQ ID NO: 24489 - protein, 15 aa, Homo sapiens
DTALETALNAKAYKR

SEQ ID NO: 24490 - protein, 15 aa, Homo sapiens
DTALETALNAKAYKR

SEQ ID NO: 24491 - protein, 7 aa, Homo sapiens
VKIKLGR

SEQ ID NO: 24492 - protein, 7 aa, Homo sapiens
VKIKLGR

SEQ ID NO: 24493 - protein, 7 aa, Homo sapiens
VKIKLGR

SEQ ID NO: 24494 - protein, 5 aa, Homo sapiens
IKLGR

SEQ ID NO: 24495 - protein, 5 aa, Homo sapiens
IKLGR

SEQ ID NO: 24496 - protein, 5 aa, Homo sapiens
IKLGR

SEQ ID NO: 24497 - protein, 7 aa, Homo sapiens
KEKAQDR

SEQ ID NO: 24498 - protein, 5 aa, Homo sapiens
IKLGR

SEQ ID NO: 24499 - protein, 7 aa, Homo sapiens
KEKAQDR

SEQ ID NO: 24500 - protein, 7 aa, Homo sapiens
KEKAQDR

SEQ ID NO: 24501 - protein, 7 aa, Homo sapiens
KEKAQDR

SEQ ID NO: 24502 - protein, 6 aa, Homo sapiens
EKAQDR

SEQ ID NO: 24503 - protein, 6 aa, Homo sapiens
EKAQDR

SEQ ID NO: 24504 - protein, 5 aa, Homo sapiens
LKGGR

SEQ ID NO: 24505 - protein, 5 aa, Homo sapiens
LKGGR

SEQ ID NO: 24506 - protein, 7 aa, Homo sapiens
ITEKLEK

SEQ ID NO: 24507 - protein, 11 aa, Homo sapiens
KELPEYYELIR

SEQ ID NO: 24508 - protein, 5 aa, Homo sapiens
LKGGR

SEQ ID NO: 24509 - protein, 4 aa, Homo sapiens
VKIK

SEQ ID NO: 24510 - protein, 7 aa, Homo sapiens
SVKVKIK

SEQ ID NO: 24511 - protein, 4 aa, Homo sapiens
VKIK

SEQ ID NO: 24512 - protein, 17 aa, Homo sapiens
VIHVESGKILTGTDAPK

SEQ ID NO: 24513 - protein, 17 aa, Homo sapiens
KKIPDPDSDDVSEVDAR

SEQ ID NO: 24514 - protein, 13 aa, Homo sapiens
LTCEEEEEKMFGR

SEQ ID NO: 24515 - protein, 13 aa, Homo sapiens
LTCEEEEEKMFGR

SEQ ID NO: 24516 - protein, 13 aa, Homo sapiens
LTCEEEEEKMFGR

SEQ ID NO: 24517 - protein, 13 aa, Homo sapiens
LTCEEEEEKMFGR

SEQ ID NO: 24518 - protein, 22 aa, Homo sapiens
HIIENAKQDVDDEYGVSQALAR

SEQ ID NO: 24519 - protein, 10 aa, Homo sapiens
VSYKGSPAAR

SEQ ID NO: 24520 - protein, 11 aa, Homo sapiens
KELPEYYELIR

SEQ ID NO: 24521 - protein, 7 aa, Homo sapiens
KEKAQDR

SEQ ID NO: 24522 - protein, 8 aa, Homo sapiens
SVTGKIQK

SEQ ID NO: 24523 - protein, 9 aa, Homo sapiens
KEKLPQVTR

SEQ ID NO: 24524 - protein, 23 aa, Homo sapiens
ELFQEMNIELVPPYMIASKEAVR

SEQ ID NO: 24525 - protein, 23 aa, Homo sapiens
ELFQEMNIELVPPYMIASKEAVR

SEQ ID NO: 24526 - protein, 9 aa, Homo sapiens
KEKLPQVTR

SEQ ID NO: 24527 - protein, 13 aa, Homo sapiens
QEYEEGGKQCVER

SEQ ID NO: 24528 - protein, 13 aa, Homo sapiens
QEYEEGGKQCVER

SEQ ID NO: 24529 - protein, 13 aa, Homo sapiens
QEYEEGGKQCVER

SEQ ID NO: 24530 - protein, 13 aa, Homo sapiens
QEYEEGGKQCVER

SEQ ID NO: 24531 - protein, 13 aa, Homo sapiens
QEYEEGGKQCVER

SEQ ID NO: 24532 - protein, 20 aa, Homo sapiens
EKLTELMFEHYNIPAFFLCK

SEQ ID NO: 24533 - protein, 20 aa, Homo sapiens
EKLTELMFEHYNIPAFFLCK

SEQ ID NO: 24534 - protein, 9 aa, Homo sapiens
EGSPANWKR

SEQ ID NO: 24535 - protein, 9 aa, Homo sapiens
KEKLPQVTR

SEQ ID NO: 24536 - protein, 9 aa, Homo sapiens
KEKLPQVTR

SEQ ID NO: 24537 - protein, 9 aa, Homo sapiens
EGSPANWKR

SEQ ID NO: 24538 - protein, 9 aa, Homo sapiens
EGSPANWKR

SEQ ID NO: 24539 - protein, 9 aa, Homo sapiens
EGSPANWKR

SEQ ID NO: 24540 - protein, 9 aa, Homo sapiens
EGSPANWKR

SEQ ID NO: 24541 - protein, 9 aa, Homo sapiens
KEKLPQVTR

SEQ ID NO: 24542 - protein, 9 aa, Homo sapiens
KEKLPQVTR

SEQ ID NO: 24543 - protein, 9 aa, Homo sapiens
EGSPANWKR

SEQ ID NO: 24544 - protein, 9 aa, Homo sapiens
EGSPANWKR

SEQ ID NO: 24545 - protein, 9 aa, Homo sapiens
EGSPANWKR

SEQ ID NO: 24546 - protein, 9 aa, Homo sapiens
EGSPANWKR

SEQ ID NO: 24547 - protein, 9 aa, Homo sapiens
EGSPANWKR

SEQ ID NO: 24548 - protein, 9 aa, Homo sapiens
EGSPANWKR

SEQ ID NO: 24549 - protein, 9 aa, Homo sapiens
EGSPANWKR

SEQ ID NO: 24550 - protein, 13 aa, Homo sapiens
EAVREGSPANWKR

SEQ ID NO: 24551 - protein, 13 aa, Homo sapiens
EAVREGSPANWKR

SEQ ID NO: 24552 - protein, 9 aa, Homo sapiens
EGSPANWKR

SEQ ID NO: 24553 - protein, 13 aa, Homo sapiens
EAVREGSPANWKR

SEQ ID NO: 24554 - protein, 9 aa, Homo sapiens
KEKLPQVTR

SEQ ID NO: 24555 - protein, 9 aa, Homo sapiens
EGSPANWKR

SEQ ID NO: 24556 - protein, 13 aa, Homo sapiens
EAVREGSPANWKR

SEQ ID NO: 24557 - protein, 9 aa, Homo sapiens
KEKLPQVTR

SEQ ID NO: 24558 - protein, 9 aa, Homo sapiens
EGSPANWKR

SEQ ID NO: 24559 - protein, 9 aa, Homo sapiens
EGSPANWKR

SEQ ID NO: 24560 - protein, 9 aa, Homo sapiens
EGSPANWKR

SEQ ID NO: 24561 - protein, 13 aa, Homo sapiens
EAVREGSPANWKR

SEQ ID NO: 24562 - protein, 9 aa, Homo sapiens
EGSPANWKR

SEQ ID NO: 24563 - protein, 13 aa, Homo sapiens
EAVREGSPANWKR

SEQ ID NO: 24564 - protein, 9 aa, Homo sapiens
EGSPANWKR

SEQ ID NO: 24565 - protein, 9 aa, Homo sapiens
EGSPANWKR

SEQ ID NO: 24566 - protein, 7 aa, Homo sapiens
AKDDIKK

SEQ ID NO: 24567 - protein, 6 aa, Homo sapiens
AKDDIK

SEQ ID NO: 24568 - protein, 8 aa, Homo sapiens
SRAKDDIK

SEQ ID NO: 24569 - protein, 9 aa, Homo sapiens
VMAAIEKVR

SEQ ID NO: 24570 - protein, 11 aa, Homo sapiens
IYKWVPVTEPK

SEQ ID NO: 24571 - protein, 11 aa, Homo sapiens
IYKWVPVTEPK

SEQ ID NO: 24572 - protein, 4 aa, Homo sapiens
KWEK

SEQ ID NO: 24573 - protein, 5 aa, Homo sapiens
KWEKK

SEQ ID NO: 24574 - protein, 9 aa, Homo sapiens
VMAAIEKVR

SEQ ID NO: 24575 - protein, 9 aa, Homo sapiens
VMAAIEKVR

SEQ ID NO: 24576 - protein, 7 aa, Homo sapiens
AKDDIKR

SEQ ID NO: 24577 - protein, 7 aa, Homo sapiens
AKDDIKR

SEQ ID NO: 24578 - protein, 7 aa, Homo sapiens
AKDDIKR

SEQ ID NO: 24579 - protein, 7 aa, Homo sapiens
AKDDIKR

SEQ ID NO: 24580 - protein, 9 aa, Homo sapiens
VMAAIEKVR

SEQ ID NO: 24581 - protein, 7 aa, Homo sapiens
AKDDIKR

SEQ ID NO: 24582 - protein, 9 aa, Homo sapiens
VMAAIEKVR

SEQ ID NO: 24583 - protein, 9 aa, Homo sapiens
VMAAIEKVR

SEQ ID NO: 24584 - protein, 7 aa, Homo sapiens
AKDDIKR

SEQ ID NO: 24585 - protein, 9 aa, Homo sapiens
VMAAIEKVR

SEQ ID NO: 24586 - protein, 11 aa, Homo sapiens
IYKWVPVTEPK

SEQ ID NO: 24587 - protein, 10 aa, Homo sapiens
TVFPNHTVKR

SEQ ID NO: 24588 - protein, 10 aa, Homo sapiens
TVFPNHTVKR

SEQ ID NO: 24589 - protein, 11 aa, Homo sapiens
RKGLAFLDELR

SEQ ID NO: 24590 - protein, 19 aa, Homo sapiens
DALLAGLKQDEPGQAGSQK

SEQ ID NO: 24591 - protein, 19 aa, Homo sapiens
DALLAGLKQDEPGQAGSQK

SEQ ID NO: 24592 - protein, 16 aa, Homo sapiens
SSTKQPTVGGTSSTPR

SEQ ID NO: 24593 - protein, 17 aa, Homo sapiens
AQKAIVNHPSAALMALR

SEQ ID NO: 24594 - protein, 16 aa, Homo sapiens
SSTKQPTVGGTSSTPR

SEQ ID NO: 24595 - protein, 17 aa, Homo sapiens
AQKAIVNHPSAALMALR

SEQ ID NO: 24596 - protein, 17 aa, Homo sapiens
AQKAIVNHPSAALMALR

SEQ ID NO: 24597 - protein, 10 aa, Homo sapiens
LLDDPSKQKR

SEQ ID NO: 24598 - protein, 10 aa, Homo sapiens
LLDDPSKQKR

SEQ ID NO: 24599 - protein, 10 aa, Homo sapiens
LLDDPSKQKR

SEQ ID NO: 24600 - protein, 7 aa, Homo sapiens
KFSSFFK

SEQ ID NO: 24601 - protein, 10 aa, Homo sapiens
LLDDPSKQKR

SEQ ID NO: 24602 - protein, 11 aa, Homo sapiens
VEGKLLDDPSK

SEQ ID NO: 24603 - protein, 11 aa, Homo sapiens
VEGKLLDDPSK

SEQ ID NO: 24604 - protein, 8 aa, Homo sapiens
KLDQTIAR

SEQ ID NO: 24605 - protein, 10 aa, Homo sapiens
KMADKVLPQR

SEQ ID NO: 24606 - protein, 9 aa, Homo sapiens
MEIQEAIKK

SEQ ID NO: 24607 - protein, 9 aa, Homo sapiens
MEIQEAIKK

SEQ ID NO: 24608 - protein, 7 aa, Homo sapiens
KFSSFFK

SEQ ID NO: 24609 - protein, 27 aa, Homo sapiens
IFISNTFNPAKSDAEDGEGTVASWELR

SEQ ID NO: 24610 - protein, 19 aa, Homo sapiens
KRPAPQQIQQVQQQAVQNR

SEQ ID NO: 24611 - protein, 19 aa, Homo sapiens
KRPAPQQIQQVQQQAVQNR

SEQ ID NO: 24612 - protein, 8 aa, Homo sapiens
KLDQTIMR

SEQ ID NO: 24613 - protein, 19 aa, Homo sapiens
KRPAPQQIQQVQQQAVQNR

SEQ ID NO: 24614 - protein, 9 aa, Homo sapiens
LDIQEALKR

SEQ ID NO: 24615 - protein, 10 aa, Homo sapiens
RLDIQEALKR

SEQ ID NO: 24616 - protein, 9 aa, Homo sapiens
YFYSKVQQR

SEQ ID NO: 24617 - protein, 8 aa, Homo sapiens
KLDQTIMR

SEQ ID NO: 24618 - protein, 14 aa, Homo sapiens
KEKPTDMQNFGLRT

SEQ ID NO: 24619 - protein, 21 aa, Homo sapiens
KTPQQTSASQQMLNFPDKGKE

SEQ ID NO: 24620 - protein, 21 aa, Homo sapiens
KTPQQTSASQQMLNFPDKGKE

SEQ ID NO: 24621 - protein, 21 aa, Homo sapiens
KTPQQTSASQQMLNFPDKGKE

SEQ ID NO: 24622 - protein, 14 aa, Homo sapiens
KEKPTDMQNFGLRT

SEQ ID NO: 24623 - protein, 14 aa, Homo sapiens
KEKPTDMQNFGLRT

SEQ ID NO: 24624 - protein, 14 aa, Homo sapiens
KEKPTDMQNFGLRT

SEQ ID NO: 24625 - protein, 14 aa, Homo sapiens
KEKPTDMQNFGLRT

SEQ ID NO: 24626 - protein, 21 aa, Homo sapiens
KTPQQTSASQQMLNFPDKGKE

SEQ ID NO: 24627 - protein, 21 aa, Homo sapiens
KTPQQTSASQQMLNFPDKGKE

SEQ ID NO: 24628 - protein, 14 aa, Homo sapiens
RTDMYTKKNVPSKS

SEQ ID NO: 24629 - protein, 14 aa, Homo sapiens
RTDMYTKKNVPSKS

SEQ ID NO: 24630 - protein, 14 aa, Homo sapiens
RTDMYTKKNVPSKS

SEQ ID NO: 24631 - protein, 14 aa, Homo sapiens
RTDMYTKKNVPSKS

SEQ ID NO: 24632 - protein, 14 aa, Homo sapiens
RTDMYTKKNVPSKS

SEQ ID NO: 24633 - protein, 11 aa, Homo sapiens
KSKAAASATRE

SEQ ID NO: 24634 - protein, 14 aa, Homo sapiens
RTDMYTKKNVPSKS

SEQ ID NO: 24635 - protein, 9 aa, Homo sapiens
RTDMYTKKN

SEQ ID NO: 24636 - protein, 14 aa, Homo sapiens
RTDMYTKKNVPSKS

SEQ ID NO: 24637 - protein, 9 aa, Homo sapiens
RTDMYTKKN

SEQ ID NO: 24638 - protein, 9 aa, Homo sapiens
RTDMYTKKN

SEQ ID NO: 24639 - protein, 11 aa, Homo sapiens
KSKAAASATRE

SEQ ID NO: 24640 - protein, 10 aa, Homo sapiens
KEKTSEAPKK

SEQ ID NO: 24641 - protein, 8 aa, Homo sapiens
KEPKEPRE

SEQ ID NO: 24642 - protein, 8 aa, Homo sapiens
KEPKEPRE

SEQ ID NO: 24643 - protein, 12 aa, Homo sapiens
RVEGQATDEKKE

SEQ ID NO: 24644 - protein, 8 aa, Homo sapiens
KEPKEPRE

SEQ ID NO: 24645 - protein, 8 aa, Homo sapiens
KEPKEPRE

SEQ ID NO: 24646 - protein, 8 aa, Homo sapiens
KEPKEPRE

SEQ ID NO: 24647 - protein, 8 aa, Homo sapiens
KEPKEPRE

SEQ ID NO: 24648 - protein, 8 aa, Homo sapiens
KEPKEPRE

SEQ ID NO: 24649 - protein, 8 aa, Homo sapiens
KEPKEPRE

SEQ ID NO: 24650 - protein, 12 aa, Homo sapiens
RVEGQATDEKKE

SEQ ID NO: 24651 - protein, 12 aa, Homo sapiens
RVEGQATDEKKE

SEQ ID NO: 24652 - protein, 8 aa, Homo sapiens
KEPKEPRE

SEQ ID NO: 24653 - protein, 12 aa, Homo sapiens
RVEGQATDEKKE

SEQ ID NO: 24654 - protein, 8 aa, Homo sapiens
KEPKEPRE

SEQ ID NO: 24655 - protein, 19 aa, Homo sapiens
KEGQEEVLKEVVESEGERK

SEQ ID NO: 24656 - protein, 8 aa, Homo sapiens
RKTKVERD

SEQ ID NO: 24657 - protein, 8 aa, Homo sapiens
RKTKVERD

SEQ ID NO: 24658 - protein, 19 aa, Homo sapiens
KEGQEEVLKEVVESEGERK

SEQ ID NO: 24659 - protein, 8 aa, Homo sapiens
RKTKVERD

SEQ ID NO: 24660 - protein, 8 aa, Homo sapiens
RKTKVERD

SEQ ID NO: 24661 - protein, 19 aa, Homo sapiens
KEGQEEVLKEVVESEGERK

SEQ ID NO: 24662 - protein, 8 aa, Homo sapiens
RKTKVERD

SEQ ID NO: 24663 - protein, 19 aa, Homo sapiens
KEGQEEVLKEVVESEGERK

SEQ ID NO: 24664 - protein, 8 aa, Homo sapiens
RKTKVERD

SEQ ID NO: 24665 - protein, 8 aa, Homo sapiens
RKTKVERD

SEQ ID NO: 24666 - protein, 19 aa, Homo sapiens
KEGQEEVLKEVVESEGERK

SEQ ID NO: 24667 - protein, 8 aa, Homo sapiens
RKTKVERD

SEQ ID NO: 24668 - protein, 8 aa, Homo sapiens
RKTKVERD

SEQ ID NO: 24669 - protein, 7 aa, Homo sapiens
KTKVERD

SEQ ID NO: 24670 - protein, 19 aa, Homo sapiens
KEGQEEVLKEVVESEGERK

SEQ ID NO: 24671 - protein, 19 aa, Homo sapiens
KEGQEEVLKEVVESEGERK

SEQ ID NO: 24672 - protein, 8 aa, Homo sapiens
RKTKVERD

SEQ ID NO: 24673 - protein, 19 aa, Homo sapiens
KEGQEEVLKEVVESEGERK

SEQ ID NO: 24674 - protein, 8 aa, Homo sapiens
RKTKVERD

SEQ ID NO: 24675 - protein, 12 aa, Homo sapiens
KAKHLAAVEERK

SEQ ID NO: 24676 - protein, 12 aa, Homo sapiens
KAKHLAAVEERK

SEQ ID NO: 24677 - protein, 12 aa, Homo sapiens
KAKHLAAVEERK

SEQ ID NO: 24678 - protein, 17 aa, Homo sapiens
RVASAAAKSALEEFSKM

SEQ ID NO: 24679 - protein, 17 aa, Homo sapiens
KMKEEVPTALVEAHVRK

SEQ ID NO: 24680 - protein, 17 aa, Homo sapiens
RVASAAAKSALEEFSKM

SEQ ID NO: 24681 - protein, 17 aa, Homo sapiens
RVASAAAKSALEEFSKM

SEQ ID NO: 24682 - protein, 17 aa, Homo sapiens
RVASAAAKSALEEFSKM

SEQ ID NO: 24683 - protein, 17 aa, Homo sapiens
RVASAAAKSALEEFSKM

SEQ ID NO: 24684 - protein, 17 aa, Homo sapiens
RVASAAAKSALEEFSKM

SEQ ID NO: 24685 - protein, 17 aa, Homo sapiens
RVASAAAKSALEEFSKM

SEQ ID NO: 24686 - protein, 17 aa, Homo sapiens
KMKEEVPTALVEAHVRK

SEQ ID NO: 24687 - protein, 17 aa, Homo sapiens
RVASAAAKSALEEFSKM

SEQ ID NO: 24688 - protein, 17 aa, Homo sapiens
RVASAAAKSALEEFSKM

SEQ ID NO: 24689 - protein, 17 aa, Homo sapiens
RVASAAAKSALEEFSKM

SEQ ID NO: 24690 - protein, 17 aa, Homo sapiens
KMKEEVPTALVEAHVRK

SEQ ID NO: 24691 - protein, 17 aa, Homo sapiens
KMKEEVPTALVEAHVRK

SEQ ID NO: 24692 - protein, 17 aa, Homo sapiens
KMKEEVPTALVEAHVRK

SEQ ID NO: 24693 - protein, 17 aa, Homo sapiens
KMKEEVPTALVEAHVRK

SEQ ID NO: 24694 - protein, 17 aa, Homo sapiens
KMKEEVPTALVEAHVRK

SEQ ID NO: 24695 - protein, 17 aa, Homo sapiens
KMKEEVPTALVEAHVRK

SEQ ID NO: 24696 - protein, 17 aa, Homo sapiens
RVASAAAKSALEEFSKM

SEQ ID NO: 24697 - protein, 17 aa, Homo sapiens
RVASAAAKSALEEFSKM

SEQ ID NO: 24698 - protein, 9 aa, Homo sapiens
RKVEEAAKV

SEQ ID NO: 24699 - protein, 9 aa, Homo sapiens
RKVEEAAKV

SEQ ID NO: 24700 - protein, 9 aa, Homo sapiens
RKVEEAAKV

SEQ ID NO: 24701 - protein, 8 aa, Homo sapiens
RKTKVERD

SEQ ID NO: 24702 - protein, 8 aa, Homo sapiens
RKTKVERD

SEQ ID NO: 24703 - protein, 17 aa, Homo sapiens
RVASAAAKSALEEFSKM

SEQ ID NO: 24704 - protein, 9 aa, Homo sapiens
RKVEEAAKV

SEQ ID NO: 24705 - protein, 9 aa, Homo sapiens
RKVEEAAKV

SEQ ID NO: 24706 - protein, 9 aa, Homo sapiens
RKVEEAAKV

SEQ ID NO: 24707 - protein, 9 aa, Homo sapiens
RKVEEAAKV

SEQ ID NO: 24708 - protein, 9 aa, Homo sapiens
RKVEEAAKV

SEQ ID NO: 24709 - protein, 8 aa, Homo sapiens
RKTKVERD

SEQ ID NO: 24710 - protein, 8 aa, Homo sapiens
RKTKVERD

SEQ ID NO: 24711 - protein, 8 aa, Homo sapiens
RKTKVERD

SEQ ID NO: 24712 - protein, 8 aa, Homo sapiens
RKTKVERD

SEQ ID NO: 24713 - protein, 22 aa, Homo sapiens
KEEVPTALVEAHVRKVEEAAKV

SEQ ID NO: 24714 - protein, 7 aa, Homo sapiens
KTKVERD

SEQ ID NO: 24715 - protein, 9 aa, Homo sapiens
RKVEEAAKV

SEQ ID NO: 24716 - protein, 9 aa, Homo sapiens
RKVEEAAKV

SEQ ID NO: 24717 - protein, 11 aa, Homo sapiens
KSKAAASATRE

SEQ ID NO: 24718 - protein, 11 aa, Homo sapiens
KSKAAASATRE

SEQ ID NO: 24719 - protein, 13 aa, Homo sapiens
KTSEAPKKDEEKG

SEQ ID NO: 24720 - protein, 13 aa, Homo sapiens
KTSEAPKKDEEKG

SEQ ID NO: 24721 - protein, 13 aa, Homo sapiens
KTSEAPKKDEEKG

SEQ ID NO: 24722 - protein, 13 aa, Homo sapiens
KTSEAPKKDEEKG

SEQ ID NO: 24723 - protein, 7 aa, Homo sapiens
KKDEEKG

SEQ ID NO: 24724 - protein, 15 aa, Homo sapiens
REGGGAIEEEAKEKT

SEQ ID NO: 24725 - protein, 13 aa, Homo sapiens
KTSEAPKKDEEKG

SEQ ID NO: 24726 - protein, 15 aa, Homo sapiens
REGGGAIEEEAKEKT

SEQ ID NO: 24727 - protein, 21 aa, Homo sapiens
REGGGAIEEEAKEKTSEAPKK

SEQ ID NO: 24728 - protein, 13 aa, Homo sapiens
KTSEAPKKDEEKG

SEQ ID NO: 24729 - protein, 13 aa, Homo sapiens
RKVEEAAKVTGKA

SEQ ID NO: 24730 - protein, 13 aa, Homo sapiens
RKVEEAAKVTGKA

SEQ ID NO: 24731 - protein, 7 aa, Homo sapiens
KTKVERD

SEQ ID NO: 24732 - protein, 7 aa, Homo sapiens
KTKVERD

SEQ ID NO: 24733 - protein, 13 aa, Homo sapiens
RKVEEAAKVTGKA

SEQ ID NO: 24734 - protein, 17 aa, Homo sapiens
KMKEEVPTALVEAHVRK

SEQ ID NO: 24735 - protein, 14 aa, Homo sapiens
RTDMYTKKNVPSKS

SEQ ID NO: 24736 - protein, 14 aa, Homo sapiens
RTDMYTKKNVPSKS

SEQ ID NO: 24737 - protein, 8 aa, Homo sapiens
KKNVPSKS

SEQ ID NO: 24738 - protein, 8 aa, Homo sapiens
KKNVPSKS

SEQ ID NO: 24739 - protein, 8 aa, Homo sapiens
KKNVPSKS

SEQ ID NO: 24740 - protein, 8 aa, Homo sapiens
KKNVPSKS

SEQ ID NO: 24741 - protein, 14 aa, Homo sapiens
KEKPTDMQNFGLRT

SEQ ID NO: 24742 - protein, 14 aa, Homo sapiens
KEKPTDMQNFGLRT

SEQ ID NO: 24743 - protein, 14 aa, Homo sapiens
KEKPTDMQNFGLRT

SEQ ID NO: 24744 - protein, 17 aa, Homo sapiens
KMKEEVPTALVEAHVRK

SEQ ID NO: 24745 - protein, 12 aa, Homo sapiens
KAKHLAAVEERK

SEQ ID NO: 24746 - protein, 17 aa, Homo sapiens
KMKEEVPTALVEAHVRK

SEQ ID NO: 24747 - protein, 12 aa, Homo sapiens
KAKHLAAVEERK

SEQ ID NO: 24748 - protein, 17 aa, Homo sapiens
KMKEEVPTALVEAHVRK

SEQ ID NO: 24749 - protein, 12 aa, Homo sapiens
KAKHLAAVEERK

SEQ ID NO: 24750 - protein, 17 aa, Homo sapiens
KMKEEVPTALVEAHVRK

SEQ ID NO: 24751 - protein, 17 aa, Homo sapiens
KMKEEVPTALVEAHVRK

SEQ ID NO: 24752 - protein, 12 aa, Homo sapiens
KAKHLAAVEERK

SEQ ID NO: 24753 - protein, 17 aa, Homo sapiens
KMKEEVPTALVEAHVRK

SEQ ID NO: 24754 - protein, 17 aa, Homo sapiens
KMKEEVPTALVEAHVRK

SEQ ID NO: 24755 - protein, 12 aa, Homo sapiens
KAKHLAAVEERK

SEQ ID NO: 24756 - protein, 17 aa, Homo sapiens
KMKEEVPTALVEAHVRK

SEQ ID NO: 24757 - protein, 25 aa, Homo sapiens
KSALEEFSKMKEEVPTALVEAHVRK

SEQ ID NO: 24758 - protein, 12 aa, Homo sapiens
KAKHLAAVEERK

SEQ ID NO: 24759 - protein, 12 aa, Homo sapiens
KAKHLAAVEERK

SEQ ID NO: 24760 - protein, 17 aa, Homo sapiens
KMKEEVPTALVEAHVRK

SEQ ID NO: 24761 - protein, 17 aa, Homo sapiens
KMKEEVPTALVEAHVRK

SEQ ID NO: 24762 - protein, 9 aa, Homo sapiens
RKVEEAAKV

SEQ ID NO: 24763 - protein, 9 aa, Homo sapiens
RKVEEAAKV

SEQ ID NO: 24764 - protein, 9 aa, Homo sapiens
RKVEEAAKV

SEQ ID NO: 24765 - protein, 17 aa, Homo sapiens
KMKEEVPTALVEAHVRK

SEQ ID NO: 24766 - protein, 17 aa, Homo sapiens
KMKEEVPTALVEAHVRK

SEQ ID NO: 24767 - protein, 17 aa, Homo sapiens
KMKEEVPTALVEAHVRK

SEQ ID NO: 24768 - protein, 9 aa, Homo sapiens
RKVEEAAKV

SEQ ID NO: 24769 - protein, 17 aa, Homo sapiens
KMKEEVPTALVEAHVRK

SEQ ID NO: 24770 - protein, 9 aa, Homo sapiens
RKVEEAAKV

SEQ ID NO: 24771 - protein, 17 aa, Homo sapiens
KMKEEVPTALVEAHVRK

SEQ ID NO: 24772 - protein, 9 aa, Homo sapiens
RKVEEAAKV

SEQ ID NO: 24773 - protein, 17 aa, Homo sapiens
KMKEEVPTALVEAHVRK

SEQ ID NO: 24774 - protein, 19 aa, Homo sapiens
KEGQEEVLKEVVESEGERK

SEQ ID NO: 24775 - protein, 20 aa, Homo sapiens
KEGQEEVLKEVVESEGERKT

SEQ ID NO: 24776 - protein, 22 aa, Homo sapiens
KEPKEGQEEVLKEVVESEGERK

SEQ ID NO: 24777 - protein, 22 aa, Homo sapiens
KEPKEGQEEVLKEVVESEGERK

SEQ ID NO: 24778 - protein, 22 aa, Homo sapiens
KEPKEGQEEVLKEVVESEGERK

SEQ ID NO: 24779 - protein, 22 aa, Homo sapiens
KEPKEGQEEVLKEVVESEGERK

SEQ ID NO: 24780 - protein, 22 aa, Homo sapiens
KEPKEGQEEVLKEVVESEGERK

SEQ ID NO: 24781 - protein, 15 aa, Homo sapiens
KSDGDPIVDPEKEKE

SEQ ID NO: 24782 - protein, 19 aa, Homo sapiens
KESEKSDGDPIVDPEKEKE

SEQ ID NO: 24783 - protein, 19 aa, Homo sapiens
KESEKSDGDPIVDPEKEKE

SEQ ID NO: 24784 - protein, 22 aa, Homo sapiens
KEPKEGQEEVLKEVVESEGERK

SEQ ID NO: 24785 - protein, 22 aa, Homo sapiens
KEPKEGQEEVLKEVVESEGERK

SEQ ID NO: 24786 - protein, 15 aa, Homo sapiens
KSDGDPIVDPEKEKE

SEQ ID NO: 24787 - protein, 22 aa, Homo sapiens
KEPKEGQEEVLKEVVESEGERK

SEQ ID NO: 24788 - protein, 15 aa, Homo sapiens
KSDGDPIVDPEKEKE

SEQ ID NO: 24789 - protein, 19 aa, Homo sapiens
KESEKSDGDPIVDPEKEKE

SEQ ID NO: 24790 - protein, 15 aa, Homo sapiens
KSDGDPIVDPEKEKE

SEQ ID NO: 24791 - protein, 16 aa, Homo sapiens
KTVNTKKDSESAPVKG

SEQ ID NO: 24792 - protein, 16 aa, Homo sapiens
KTVNTKKDSESAPVKG

SEQ ID NO: 24793 - protein, 16 aa, Homo sapiens
KTVNTKKDSESAPVKG

SEQ ID NO: 24794 - protein, 32 aa, Homo sapiens; identical to SEQ ID NO: 5995

SEQ ID NO: 24795 - protein, 32 aa, Homo sapiens; identical to SEQ ID NO: 5995

SEQ ID NO: 24796 - protein, 10 aa, Homo sapiens
KGKEGDSEKE

SEQ ID NO: 24797 - protein, 10 aa, Homo sapiens
KGKEGDSEKE

SEQ ID NO: 24798 - protein, 10 aa, Homo sapiens
KGKEGDSEKE

SEQ ID NO: 24799 - protein, 10 aa, Homo sapiens
KGKEGDSEKE

SEQ ID NO: 24800 - protein, 7 aa, Homo sapiens
KKDEEKG

SEQ ID NO: 24801 - protein, 7 aa, Homo sapiens
KKDEEKG

SEQ ID NO: 24802 - protein, 9 aa, Homo sapiens
KKDEEKGKE

SEQ ID NO: 24803 - protein, 9 aa, Homo sapiens
KKDEEKGKE

SEQ ID NO: 24804 - protein, 9 aa, Homo sapiens
KKDEEKGKE

SEQ ID NO: 24805 - protein, 9 aa, Homo sapiens
KKDEEKGKE

SEQ ID NO: 24806 - protein, 9 aa, Homo sapiens
KKDEEKGKE

SEQ ID NO: 24807 - protein, 7 aa, Homo sapiens
KKKNAKK

SEQ ID NO: 24808 - protein, 25 aa, Homo sapiens
KSALEEFSKMKEEVPTALVEAHVRK

SEQ ID NO: 24809 - protein, 25 aa, Homo sapiens
KSALEEFSKMKEEVPTALVEAHVRK

SEQ ID NO: 24810 - protein, 25 aa, Homo sapiens
KSALEEFSKMKEEVPTALVEAHVRK

SEQ ID NO: 24811 - protein, 26 aa, Homo sapiens
RKDPSAFFSFPVTDFIAPGYSMIIKH

SEQ ID NO: 24812 - protein, 17 aa, Homo sapiens
RLDLPPEKPLTSSLAKQ

SEQ ID NO: 24813 - protein, 7 aa, Homo sapiens
RIEKERM

SEQ ID NO: 24814 - protein, 7 aa, Homo sapiens
RIEKERM

SEQ ID NO: 24815 - protein, 7 aa, Homo sapiens
RIEKERM

SEQ ID NO: 24816 - protein, 9 aa, Homo sapiens
RKPVDFKKI

SEQ ID NO: 24817 - protein, 9 aa, Homo sapiens
RIRNHKYRS

SEQ ID NO: 24818 - protein, 7 aa, Homo sapiens
KKIKERI

SEQ ID NO: 24819 - protein, 12 aa, Homo sapiens
RASGKFELLDRI

SEQ ID NO: 24820 - protein, 7 aa, Homo sapiens
KKIKERI

SEQ ID NO: 24821 - protein, 18 aa, Homo sapiens
KVIQAGMFDQKSSSHERR

SEQ ID NO: 24822 - protein, 10 aa, Homo sapiens
KYKLNVDQKV

SEQ ID NO: 24823 - protein, 10 aa, Homo sapiens
KYKLNVDQKV

SEQ ID NO: 24824 - protein, 18 aa, Homo sapiens
KVIQAGMFDQKSSSHERR

SEQ ID NO: 24825 - protein, 18 aa, Homo sapiens
KVIQAGMFDQKSSSHERR

SEQ ID NO: 24826 - protein, 18 aa, Homo sapiens
KVIQAGMFDQKSSSHERR

SEQ ID NO: 24827 - protein, 18 aa, Homo sapiens
KVIQAGMFDQKSSSHERR

SEQ ID NO: 24828 - protein, 9 aa, Homo sapiens
RKPVDFKKI

SEQ ID NO: 24829 - protein, 18 aa, Homo sapiens
KGKGGAKTLMNTIMQLRK

SEQ ID NO: 24830 - protein, 13 aa, Homo sapiens
RAQILAYKMLARG

SEQ ID NO: 24831 - protein, 13 aa, Homo sapiens
RAQILAYKMLARG

SEQ ID NO: 24832 - protein, 22 aa, Homo sapiens
RLMEEDELPSWIIKDDAEVERL

SEQ ID NO: 24833 - protein, 22 aa, Homo sapiens
RLMEEDELPSWIIKDDAEVERL

SEQ ID NO: 24834 - protein, 10 aa, Homo sapiens
KYKLNVDQKV

SEQ ID NO: 24835 - protein, 10 aa, Homo sapiens
KYKLNVDQKV

SEQ ID NO: 24836 - protein, 8 aa, Homo sapiens
REQKAKRN

SEQ ID NO: 24837 - protein, 8 aa, Homo sapiens
REQKAKRN

SEQ ID NO: 24838 - protein, 8 aa, Homo sapiens
REQKAKRN

SEQ ID NO: 24839 - protein, 7 aa, Homo sapiens
REQKAKR

SEQ ID NO: 24840 - protein, 8 aa, Homo sapiens
KTKPNTKD

SEQ ID NO: 24841 - protein, 11 aa, Homo sapiens
KSKDKAATPRK

SEQ ID NO: 24842 - protein, 11 aa, Homo sapiens
KSKDKAATPRK

SEQ ID NO: 24843 - protein, 11 aa, Homo sapiens
KSKDKAATPRK

SEQ ID NO: 24844 - protein, 7 aa, Homo sapiens
RKDGPKR

SEQ ID NO: 24845 - protein, 7 aa, Homo sapiens
RKDGPKR

SEQ ID NO: 24846 - protein, 7 aa, Homo sapiens
RKDGPKR

SEQ ID NO: 24847 - protein, 11 aa, Homo sapiens
KSKDKAATPRK

SEQ ID NO: 24848 - protein, 8 aa, Homo sapiens
RKDGPKRS

SEQ ID NO: 24849 - protein, 11 aa, Homo sapiens
KSKDKAATPRK

SEQ ID NO: 24850 - protein, 8 aa, Homo sapiens
RKDGPKRS

SEQ ID NO: 24851 - protein, 11 aa, Homo sapiens
KSKDKAATPRK

SEQ ID NO: 24852 - protein, 8 aa, Homo sapiens
RKDGPKRS

SEQ ID NO: 24853 - protein, 11 aa, Homo sapiens
KSKDKAATPRK

SEQ ID NO: 24854 - protein, 8 aa, Homo sapiens
RKDGPKRS

SEQ ID NO: 24855 - protein, 7 aa, Homo sapiens
RKDGPKR

SEQ ID NO: 24856 - protein, 8 aa, Homo sapiens
RKDGPKRS

SEQ ID NO: 24857 - protein, 8 aa, Homo sapiens
RKDGPKRS

SEQ ID NO: 24858 - protein, 11 aa, Homo sapiens
KSKDKAATPRK

SEQ ID NO: 24859 - protein, 8 aa, Homo sapiens
RKDGPKRS

SEQ ID NO: 24860 - protein, 8 aa, Homo sapiens
RKDGPKRS

SEQ ID NO: 24861 - protein, 8 aa, Homo sapiens
RKDGPKRS

SEQ ID NO: 24862 - protein, 8 aa, Homo sapiens
RKDGPKRS

SEQ ID NO: 24863 - protein, 7 aa, Homo sapiens
KKAAKKA

SEQ ID NO: 24864 - protein, 13 aa, Homo sapiens
KVEASKVPEYIKK

SEQ ID NO: 24865 - protein, 7 aa, Homo sapiens
KKAAKKA

SEQ ID NO: 24866 - protein, 12 aa, Homo sapiens
KVPEYIKKAAKK

SEQ ID NO: 24867 - protein, 16 aa, Homo sapiens
KAAKKAAEFNSNLNRE

SEQ ID NO: 24868 - protein, 16 aa, Homo sapiens
KAAKKAAEFNSNLNRE

SEQ ID NO: 24869 - protein, 12 aa, Homo sapiens
KVPEYIKKAAKK

SEQ ID NO: 24870 - protein, 13 aa, Homo sapiens
RSVLSKSVPGYKP

SEQ ID NO: 24871 - protein, 7 aa, Homo sapiens
RKDGPKR

SEQ ID NO: 24872 - protein, 8 aa, Homo sapiens
RKDGPKRS

SEQ ID NO: 24873 - protein, 25 aa, Homo sapiens
RITDHYKEYSQMQQQNTQKVEASKV

SEQ ID NO: 24874 - protein, 25 aa, Homo sapiens
RITDHYKEYSQMQQQNTQKVEASKV

SEQ ID NO: 24875 - protein, 17 aa, Homo sapiens
RSDEVIDLMIKEYPAKH

SEQ ID NO: 24876 - protein, 17 aa, Homo sapiens
RSDEVIDLMIKEYPAKH

SEQ ID NO: 24877 - protein, 10 aa, Homo sapiens
RKYPDLERRD

SEQ ID NO: 24878 - protein, 10 aa, Homo sapiens
RKYPDLERRD

SEQ ID NO: 24879 - protein, 10 aa, Homo sapiens
RKYPDLERRD

SEQ ID NO: 24880 - protein, 17 aa, Homo sapiens
RSDEVIDLMIKEYPAKH

SEQ ID NO: 24881 - protein, 17 aa, Homo sapiens
RSDEVIDLMIKEYPAKH

SEQ ID NO: 24882 - protein, 10 aa, Homo sapiens
RKYPDLERRD

SEQ ID NO: 24883 - protein, 10 aa, Homo sapiens
RKYPDLERRD

SEQ ID NO: 24884 - protein, 17 aa, Homo sapiens
RSDEVIDLMIKEYPAKH

SEQ ID NO: 24885 - protein, 17 aa, Homo sapiens
RSDEVIDLMIKEYPAKH

SEQ ID NO: 24886 - protein, 9 aa, Homo sapiens
RKYPDLERR

SEQ ID NO: 24887 - protein, 18 aa, Homo sapiens
KEYPAKHAEYSVILQEKE

SEQ ID NO: 24888 - protein, 10 aa, Homo sapiens
RKYPDLERRD

SEQ ID NO: 24889 - protein, 10 aa, Homo sapiens
RKYPDLERRD

SEQ ID NO: 24890 - protein, 20 aa, Homo sapiens
KEYPAKHAEYSVILQEKERQ

SEQ ID NO: 24891 - protein, 10 aa, Homo sapiens
RKYPDLERRD

SEQ ID NO: 24892 - protein, 9 aa, Homo sapiens
RKYPDLERR

SEQ ID NO: 24893 - protein, 9 aa, Homo sapiens
RKYPDLERR

SEQ ID NO: 24894 - protein, 20 aa, Homo sapiens
KEYPAKHAEYSVILQEKERQ

SEQ ID NO: 24895 - protein, 10 aa, Homo sapiens
RKYPDLERRD

SEQ ID NO: 24896 - protein, 10 aa, Homo sapiens
RKYPDLERRD

SEQ ID NO: 24897 - protein, 9 aa, Homo sapiens
RKYPDLERR

SEQ ID NO: 24898 - protein, 20 aa, Homo sapiens
KEYPAKHAEYSVILQEKERQ

SEQ ID NO: 24899 - protein, 10 aa, Homo sapiens
KRKYPDLERR

SEQ ID NO: 24900 - protein, 9 aa, Homo sapiens
RKYPDLERR

SEQ ID NO: 24901 - protein, 10 aa, Homo sapiens
RKYPDLERRD

SEQ ID NO: 24902 - protein, 18 aa, Homo sapiens
KEYPAKHAEYSVILQEKE

SEQ ID NO: 24903 - protein, 9 aa, Homo sapiens
RDLSHKEKL

SEQ ID NO: 24904 - protein, 9 aa, Homo sapiens
KDKAATPRK

SEQ ID NO: 24905 - protein, 23 aa, Homo sapiens
RTKVSSYPVALIPGQFQEYYKRY

SEQ ID NO: 24906 - protein, 10 aa, Homo sapiens
KYKVLPTERT

SEQ ID NO: 24907 - protein, 10 aa, Homo sapiens
KYKVLPTERT

SEQ ID NO: 24908 - protein, 10 aa, Homo sapiens
KYKVLPTERT

SEQ ID NO: 24909 - protein, 8 aa, Homo sapiens
RKDGPKRS

SEQ ID NO: 24910 - protein, 15 aa, Homo sapiens
RSVLSKSVPGYKPKV

SEQ ID NO: 24911 - protein, 8 aa, Homo sapiens
RHQEKKRK

SEQ ID NO: 24912 - protein, 8 aa, Homo sapiens
RHQEKKRK

SEQ ID NO: 24913 - protein, 8 aa, Homo sapiens
RHQEKKRK

SEQ ID NO: 24914 - protein, 8 aa, Homo sapiens
RHQEKKRK

SEQ ID NO: 24915 - protein, 8 aa, Homo sapiens
RHQEKKRK

SEQ ID NO: 24916 - protein, 16 aa, Homo sapiens
KFLESTDSFNNELKRL

SEQ ID NO: 24917 - protein, 17 aa, Homo sapiens
RKFLESTDSFNNELKRL

SEQ ID NO: 24918 - protein, 17 aa, Homo sapiens
RKFLESTDSFNNELKRL

SEQ ID NO: 24919 - protein, 16 aa, Homo sapiens
KFLESTDSFNNELKRL

SEQ ID NO: 24920 - protein, 22 aa, Homo sapiens
KVEVDMEKIAAEIAQAEEQARK

SEQ ID NO: 24921 - protein, 13 aa, Homo sapiens
KPPDKPLMPYMRY

SEQ ID NO: 24922 - protein, 13 aa, Homo sapiens
KPPDKPLMPYMRY

SEQ ID NO: 24923 - protein, 13 aa, Homo sapiens
KPPDKPLMPYMRY

SEQ ID NO: 24924 - protein, 13 aa, Homo sapiens
KPPDKPLMPYMRY

SEQ ID NO: 24925 - protein, 13 aa, Homo sapiens
KPPDKPLMPYMRY

SEQ ID NO: 24926 - protein, 13 aa, Homo sapiens
KPPDKPLMPYMRY

SEQ ID NO: 24927 - protein, 13 aa, Homo sapiens
KPPDKPLMPYMRY

SEQ ID NO: 24928 - protein, 13 aa, Homo sapiens
KPPDKPLMPYMRY

SEQ ID NO: 24929 - protein, 13 aa, Homo sapiens
KPPDKPLMPYMRY

SEQ ID NO: 24930 - protein, 13 aa, Homo sapiens
KPPDKPLMPYMRY

SEQ ID NO: 24931 - protein, 13 aa, Homo sapiens
KPPDKPLMPYMRY

SEQ ID NO: 24932 - protein, 17 aa, Homo sapiens
RKIKSLVALLVETQMKK

SEQ ID NO: 24933 - protein, 17 aa, Homo sapiens
RKIKSLVALLVETQMKK

SEQ ID NO: 24934 - protein, 17 aa, Homo sapiens
RVASAAAKAALEEFSRV

SEQ ID NO: 24935 - protein, 17 aa, Homo sapiens
RVASAAAKAALEEFSRV

SEQ ID NO: 24936 - protein, 17 aa, Homo sapiens
RVASAAAKAALEEFSRV

SEQ ID NO: 24937 - protein, 18 aa, Homo sapiens
RVREEVPLELVEAHVKKV

SEQ ID NO: 24938 - protein, 17 aa, Homo sapiens
RVASAAAKAALEEFSRV

SEQ ID NO: 24939 - protein, 17 aa, Homo sapiens
RVASAAAKAALEEFSRV

SEQ ID NO: 24940 - protein, 9 aa, Homo sapiens
KKVQEAARA

SEQ ID NO: 24941 - protein, 9 aa, Homo sapiens
KKVQEAARA

SEQ ID NO: 24942 - protein, 9 aa, Homo sapiens
KKVQEAARA

SEQ ID NO: 24943 - protein, 16 aa, Homo sapiens
RISTKNEEPVRSPERR

SEQ ID NO: 24944 - protein, 9 aa, Homo sapiens
RKASANARK

SEQ ID NO: 24945 - protein, 9 aa, Homo sapiens
RKASANARK

SEQ ID NO: 24946 - protein, 9 aa, Homo sapiens
RKASANARK

SEQ ID NO: 24947 - protein, 16 aa, Homo sapiens
RISTKNEEPVRSPERR

SEQ ID NO: 24948 - protein, 13 aa, Homo sapiens
RTDIYSKKTLAKS

SEQ ID NO: 24949 - protein, 7 aa, Homo sapiens
RKKSGKK

SEQ ID NO: 24950 - protein, 12 aa, Homo sapiens
KKGQASLYGKRR

SEQ ID NO: 24951 - protein, 7 aa, Homo sapiens
RKKSGKK

SEQ ID NO: 24952 - protein, 11 aa, Homo sapiens
KKGQASLYGKR

SEQ ID NO: 24953 - protein, 7 aa, Homo sapiens
RKKSGKK

SEQ ID NO: 24954 - protein, 7 aa, Homo sapiens
RKKSGKK

SEQ ID NO: 24955 - protein, 7 aa, Homo sapiens
RKKSGKK

SEQ ID NO: 24956 - protein, 20 aa, Homo sapiens
RSPQVPAAQQMLNFPEKNKE

SEQ ID NO: 24957 - protein, 20 aa, Homo sapiens
RSPQVPAAQQMLNFPEKNKE

SEQ ID NO: 24958 - protein, 20 aa, Homo sapiens
RSPQVPAAQQMLNFPEKNKE

SEQ ID NO: 24959 - protein, 14 aa, Homo sapiens
KEKPVDLQNFGLRT

SEQ ID NO: 24960 - protein, 20 aa, Homo sapiens
RSPQVPAAQQMLNFPEKNKE

SEQ ID NO: 24961 - protein, 20 aa, Homo sapiens
RSPQVPAAQQMLNFPEKNKE

SEQ ID NO: 24962 - protein, 14 aa, Homo sapiens
KEKPVDLQNFGLRT

SEQ ID NO: 24963 - protein, 14 aa, Homo sapiens
KEKPVDLQNFGLRT

SEQ ID NO: 24964 - protein, 20 aa, Homo sapiens
RSPQVPAAQQMLNFPEKNKE

SEQ ID NO: 24965 - protein, 14 aa, Homo sapiens
KEKPVDLQNFGLRT

SEQ ID NO: 24966 - protein, 14 aa, Homo sapiens
KEKPVDLQNFGLRT

SEQ ID NO: 24967 - protein, 11 aa, Homo sapiens
KKGQASLYGKR

SEQ ID NO: 24968 - protein, 12 aa, Homo sapiens
KKGQASLYGKRR

SEQ ID NO: 24969 - protein, 7 aa, Homo sapiens
RKKSGKK

SEQ ID NO: 24970 - protein, 6 aa, Homo sapiens
KKSGKK

SEQ ID NO: 24971 - protein, 7 aa, Homo sapiens
RKKSGKK

SEQ ID NO: 24972 - protein, 13 aa, Homo sapiens
KSKTPEIYLAYRN

SEQ ID NO: 24973 - protein, 13 aa, Homo sapiens
RALPEFFNGKNKS

SEQ ID NO: 24974 - protein, 7 aa, Homo sapiens
KKTLAKS

SEQ ID NO: 24975 - protein, 9 aa, Homo sapiens
KKVQEAARA

SEQ ID NO: 24976 - protein, 9 aa, Homo sapiens
KKVQEAARA

SEQ ID NO: 24977 - protein, 9 aa, Homo sapiens
KKVQEAARA

SEQ ID NO: 24978 - protein, 9 aa, Homo sapiens
KKVQEAARA

SEQ ID NO: 24979 - protein, 9 aa, Homo sapiens
KKVQEAARA

SEQ ID NO: 24980 - protein, 9 aa, Homo sapiens
KKVQEAARA

SEQ ID NO: 24981 - protein, 14 aa, Homo sapiens
KTLAKSKGASAGRE

SEQ ID NO: 24982 - protein, 8 aa, Homo sapiens
KTLAKSKG

SEQ ID NO: 24983 - protein, 8 aa, Homo sapiens
KTLAKSKG

SEQ ID NO: 24984 - protein, 13 aa, Homo sapiens
RTDIYSKKTLAKS

SEQ ID NO: 24985 - protein, 10 aa, Homo sapiens
KSKGASAGRE

SEQ ID NO: 24986 - protein, 9 aa, Homo sapiens
RTDIYSKKT

SEQ ID NO: 24987 - protein, 9 aa, Homo sapiens
RTDIYSKKT

SEQ ID NO: 24988 - protein, 24 aa, Homo sapiens
RKDLYANTVLSGGTTMYPGIADRM

SEQ ID NO: 24989 - protein, 24 aa, Homo sapiens
RKDLYANTVLSGGTTMYPGIADRM

SEQ ID NO: 24990 - protein, 24 aa, Homo sapiens
RKDLYANTVLSGGTTMYPGIADRM

SEQ ID NO: 24991 - protein, 24 aa, Homo sapiens
RKDLYANTVLSGGTTMYPGIADRM

SEQ ID NO: 24992 - protein, 24 aa, Homo sapiens
RKDLYANTVLSGGTTMYPGIADRM

SEQ ID NO: 24993 - protein, 24 aa, Homo sapiens
RKDLYANTVLSGGTTMYPGIADRM

SEQ ID NO: 24994 - protein, 15 aa, Homo sapiens
KEITALAPSTMKIKI

SEQ ID NO: 24995 - protein, 15 aa, Homo sapiens
KEITALAPSTMKIKI

SEQ ID NO: 24996 - protein, 24 aa, Homo sapiens
RKDLYANTVLSGGTTMYPGIADRM

SEQ ID NO: 24997 - protein, 24 aa, Homo sapiens
RKDLYANTVLSGGTTMYPGIADRM

SEQ ID NO: 24998 - protein, 24 aa, Homo sapiens
RKDLYANTVLSGGTTMYPGIADRM

SEQ ID NO: 24999 - protein, 24 aa, Homo sapiens
RKDLYANTVLSGGTTMYPGIADRM

SEQ ID NO: 25000 - protein, 24 aa, Homo sapiens
RKDLYANTVLSGGTTMYPGIADRM

SEQ ID NO: 25001 - protein, 24 aa, Homo sapiens
RKDLYANTVLSGGTTMYPGIADRM

SEQ ID NO: 25002 - protein, 24 aa, Homo sapiens
RKDLYANTVLSGGTTMYPGIADRM

SEQ ID NO: 25003 - protein, 24 aa, Homo sapiens
RKDLYANTVLSGGTTMYPGIADRM

SEQ ID NO: 25004 - protein, 24 aa, Homo sapiens
RKDLYANTVLSGGTTMYPGIADRM

SEQ ID NO: 25005 - protein, 24 aa, Homo sapiens
RKDLYANTVLSGGTTMYPGIADRM

SEQ ID NO: 25006 - protein, 24 aa, Homo sapiens
RKDLYANTVLSGGTTMYPGIADRM

SEQ ID NO: 25007 - protein, 24 aa, Homo sapiens
RKDLYANTVLSGGTTMYPGIADRM

SEQ ID NO: 25008 - protein, 24 aa, Homo sapiens
RKDLYANTVLSGGTTMYPGIADRM

SEQ ID NO: 25009 - protein, 24 aa, Homo sapiens
RKDLYANTVLSGGTTMYPGIADRM

SEQ ID NO: 25010 - protein, 24 aa, Homo sapiens
RKDLYANTVLSGGTTMYPGIADRM

SEQ ID NO: 25011 - protein, 24 aa, Homo sapiens
RKDLYANTVLSGGTTMYPGIADRM

SEQ ID NO: 25012 - protein, 24 aa, Homo sapiens
RKDLYANTVLSGGTTMYPGIADRM

SEQ ID NO: 25013 - protein, 24 aa, Homo sapiens
RKDLYANTVLSGGTTMYPGIADRM

SEQ ID NO: 25014 - protein, 23 aa, Homo sapiens
RVAPEEHPVLLTEAPLNPKANRE

SEQ ID NO: 25015 - protein, 23 aa, Homo sapiens
RVAPEEHPVLLTEAPLNPKANRE

SEQ ID NO: 25016 - protein, 23 aa, Homo sapiens
RVAPEEHPVLLTEAPLNPKANRE

SEQ ID NO: 25017 - protein, 23 aa, Homo sapiens
RVAPEEHPVLLTEAPLNPKANRE

SEQ ID NO: 25018 - protein, 23 aa, Homo sapiens
RVAPEEHPVLLTEAPLNPKANRE

SEQ ID NO: 25019 - protein, 23 aa, Homo sapiens
RVAPEEHPVLLTEAPLNPKANRE

SEQ ID NO: 25020 - protein, 14 aa, Homo sapiens
KDSYVGDEAQSKRG

SEQ ID NO: 25021 - protein, 16 aa, Homo sapiens
RMQKEITALAPSTMKI

SEQ ID NO: 25022 - protein, 22 aa, Homo sapiens
KEITALAPSTMKIKIIAPPERK

SEQ ID NO: 25023 - protein, 25 aa, Homo sapiens
RLISELFQKLPSKVQYPDYYAIIKE

SEQ ID NO: 25024 - protein, 15 aa, Homo sapiens
RNLETAKKAEYEERA

SEQ ID NO: 25025 - protein, 12 aa, Homo sapiens
RAAKVAEQQERE

SEQ ID NO: 25026 - protein, 12 aa, Homo sapiens
RAAKVAEQQERE

SEQ ID NO: 25027 - protein, 12 aa, Homo sapiens
RAAKVAEQQERE

SEQ ID NO: 25028 - protein, 9 aa, Homo sapiens
RNLETAKKA

SEQ ID NO: 25029 - protein, 12 aa, Homo sapiens
RAAKVAEQQERE

SEQ ID NO: 25030 - protein, 9 aa, Homo sapiens
RNLETAKKA

SEQ ID NO: 25031 - protein, 9 aa, Homo sapiens
RNLETAKKA

SEQ ID NO: 25032 - protein, 12 aa, Homo sapiens
KKYPDYYQQIKM

SEQ ID NO: 25033 - protein, 21 aa, Homo sapiens
KKYPDYYQQIKMPISLQQIRT

SEQ ID NO: 25034 - protein, 21 aa, Homo sapiens
KKYPDYYQQIKMPISLQQIRT

SEQ ID NO: 25035 - protein, 19 aa, Homo sapiens
RAVIKAQHPDYSFGELSRL

SEQ ID NO: 25036 - protein, 19 aa, Homo sapiens
RAVIKAQHPDYSFGELSRL

SEQ ID NO: 25037 - protein, 19 aa, Homo sapiens
RAVIKAQHPDYSFGELSRL

SEQ ID NO: 25038 - protein, 19 aa, Homo sapiens
RAVIKAQHPDYSFGELSRL

SEQ ID NO: 25039 - protein, 8 aa, Homo sapiens
RKEKLPKE

SEQ ID NO: 25040 - protein, 8 aa, Homo sapiens
RKEKLPKE

SEQ ID NO: 25041 - protein, 8 aa, Homo sapiens
RKEKLPKE

SEQ ID NO: 25042 - protein, 8 aa, Homo sapiens
RKEKLPKE

SEQ ID NO: 25043 - protein, 8 aa, Homo sapiens
RKEKLPKE

SEQ ID NO: 25044 - protein, 8 aa, Homo sapiens
RKEKLPKE

SEQ ID NO: 25045 - protein, 8 aa, Homo sapiens
RKEKLPKE

SEQ ID NO: 25046 - protein, 7 aa, Homo sapiens
KLKLSRK

SEQ ID NO: 25047 - protein, 13 aa, Homo sapiens
KKSKYMTPMQQKL

SEQ ID NO: 25048 - protein, 13 aa, Homo sapiens
KKSKYMTPMQQKL

SEQ ID NO: 25049 - protein, 7 aa, Homo sapiens
KLLKEKR

SEQ ID NO: 25050 - protein, 7 aa, Homo sapiens
KLLKEKR

SEQ ID NO: 25051 - protein, 18 aa, Homo sapiens
RKELGPLPDDDDMASPKL

SEQ ID NO: 25052 - protein, 7 aa, Homo sapiens
KLLKEKR

SEQ ID NO: 25053 - protein, 13 aa, Homo sapiens
KKSKYMTPMQQKL

SEQ ID NO: 25054 - protein, 12 aa, Homo sapiens
KSKYMTPMQQKL

SEQ ID NO: 25055 - protein, 13 aa, Homo sapiens
KKSKYMTPMQQKL

SEQ ID NO: 25056 - protein, 14 aa, Homo sapiens
RVLKLQQVMQAKKK

SEQ ID NO: 25057 - protein, 11 aa, Homo sapiens
KLQQVMQAKKK

SEQ ID NO: 25058 - protein, 11 aa, Homo sapiens
KLQQVMQAKKK

SEQ ID NO: 25059 - protein, 8 aa, Homo sapiens
KKKELARR

SEQ ID NO: 25060 - protein, 7 aa, Homo sapiens
KKELARR

SEQ ID NO: 25061 - protein, 7 aa, Homo sapiens
KKELARR

SEQ ID NO: 25062 - protein, 9 aa, Homo sapiens
RKSGISPKK

SEQ ID NO: 25063 - protein, 7 aa, Homo sapiens
KLKLSRK

SEQ ID NO: 25064 - protein, 17 aa, Homo sapiens
RKPIVPQKEPSPLLEKK

SEQ ID NO: 25065 - protein, 10 aa, Homo sapiens
KKIQLLEAKF

SEQ ID NO: 25066 - protein, 10 aa, Homo sapiens
KKIQLLEAKF

SEQ ID NO: 25067 - protein, 7 aa, Homo sapiens
RAPKRRN

SEQ ID NO: 25068 - protein, 7 aa, Homo sapiens
RAPKRRN

SEQ ID NO: 25069 - protein, 7 aa, Homo sapiens
KTKSFKK

SEQ ID NO: 25070 - protein, 7 aa, Homo sapiens
KTKSFKK

SEQ ID NO: 25071 - protein, 13 aa, Homo sapiens
RVLKLQQVMQAKK

SEQ ID NO: 25072 - protein, 13 aa, Homo sapiens
RYNVPNSAIYKRV

SEQ ID NO: 25073 - protein, 14 aa, Homo sapiens
KRYNVPNSAIYKRV

SEQ ID NO: 25074 - protein, 14 aa, Homo sapiens
KRYNVPNSAIYKRV

SEQ ID NO: 25075 - protein, 14 aa, Homo sapiens
RVLKLQQVMQAKKK

SEQ ID NO: 25076 - protein, 13 aa, Homo sapiens
RVLKLQQVMQAKK

SEQ ID NO: 25077 - protein, 13 aa, Homo sapiens
RYNVPNSAIYKRV

SEQ ID NO: 25078 - protein, 14 aa, Homo sapiens
KRYNVPNSAIYKRV

SEQ ID NO: 25079 - protein, 14 aa, Homo sapiens
KRYNVPNSAIYKRV

SEQ ID NO: 25080 - protein, 13 aa, Homo sapiens
RVLKLQQVMQAKK

SEQ ID NO: 25081 - protein, 13 aa, Homo sapiens
RVLKLQQVMQAKK

SEQ ID NO: 25082 - protein, 13 aa, Homo sapiens
RYNVPNSAIYKRV

SEQ ID NO: 25083 - protein, 13 aa, Homo sapiens
RVLKLQQVMQAKK

SEQ ID NO: 25084 - protein, 14 aa, Homo sapiens
KRYNVPNSAIYKRV

SEQ ID NO: 25085 - protein, 13 aa, Homo sapiens
RVLKLQQVMQAKK

SEQ ID NO: 25086 - protein, 14 aa, Homo sapiens
RVLKLQQVMQAKKK

SEQ ID NO: 25087 - protein, 13 aa, Homo sapiens
RVLKLQQVMQAKK

SEQ ID NO: 25088 - protein, 14 aa, Homo sapiens
RVLKLQQVMQAKKK

SEQ ID NO: 25089 - protein, 13 aa, Homo sapiens
RVLKLQQVMQAKK

SEQ ID NO: 25090 - protein, 13 aa, Homo sapiens
RYNVPNSAIYKRV

SEQ ID NO: 25091 - protein, 13 aa, Homo sapiens
RYNVPNSAIYKRV

SEQ ID NO: 25092 - protein, 14 aa, Homo sapiens
KRYNVPNSAIYKRV

SEQ ID NO: 25093 - protein, 13 aa, Homo sapiens
RVLKLQQVMQAKK

SEQ ID NO: 25094 - protein, 13 aa, Homo sapiens
RYNVPNSAIYKRV

SEQ ID NO: 25095 - protein, 14 aa, Homo sapiens
RVLKLQQVMQAKKK

SEQ ID NO: 25096 - protein, 14 aa, Homo sapiens
RVLKLQQVMQAKKK

SEQ ID NO: 25097 - protein, 14 aa, Homo sapiens
KRYNVPNSAIYKRV

SEQ ID NO: 25098 - protein, 13 aa, Homo sapiens
RVLKLQQVMQAKK

SEQ ID NO: 25099 - protein, 13 aa, Homo sapiens
RVLKLQQVMQAKK

SEQ ID NO: 25100 - protein, 13 aa, Homo sapiens
RVLKLQQVMQAKK

SEQ ID NO: 25101 - protein, 13 aa, Homo sapiens
RYNVPNSAIYKRV

SEQ ID NO: 25102 - protein, 13 aa, Homo sapiens
RYNVPNSAIYKRV

SEQ ID NO: 25103 - protein, 13 aa, Homo sapiens
RYNVPNSAIYKRV

SEQ ID NO: 25104 - protein, 13 aa, Homo sapiens
RYNVPNSAIYKRV

SEQ ID NO: 25105 - protein, 13 aa, Homo sapiens
RYNVPNSAIYKRV

SEQ ID NO: 25106 - protein, 13 aa, Homo sapiens
RYNVPNSAIYKRV

SEQ ID NO: 25107 - protein, 13 aa, Homo sapiens
RYNVPNSAIYKRV

SEQ ID NO: 25108 - protein, 13 aa, Homo sapiens
RYNVPNSAIYKRV

SEQ ID NO: 25109 - protein, 13 aa, Homo sapiens
RVLKLQQVMQAKK

SEQ ID NO: 25110 - protein, 13 aa, Homo sapiens
RVLKLQQVMQAKK

SEQ ID NO: 25111 - protein, 21 aa, Homo sapiens
REAEKSEDSSGAAGLSGLHRT

SEQ ID NO: 25112 - protein, 8 aa, Homo sapiens
RYSAKTKS

SEQ ID NO: 25113 - protein, 8 aa, Homo sapiens
RYSAKTKS

SEQ ID NO: 25114 - protein, 13 aa, Homo sapiens
KHLHNDVEKERKE

SEQ ID NO: 25115 - protein, 8 aa, Homo sapiens
RKEKLPKE

SEQ ID NO: 25116 - protein, 12 aa, Homo sapiens
RYNESDKQMKKF

SEQ ID NO: 25117 - protein, 12 aa, Homo sapiens
RYNESDKQMKKF

SEQ ID NO: 25118 - protein, 8 aa, Homo sapiens
KFKGLKRF

SEQ ID NO: 25119 - protein, 7 aa, Homo sapiens
KFKGLKR

SEQ ID NO: 25120 - protein, 8 aa, Homo sapiens
KFKGLKRF

SEQ ID NO: 25121 - protein, 12 aa, Homo sapiens
RYNESDKQMKKF

SEQ ID NO: 25122 - protein, 12 aa, Homo sapiens
RYNESDKQMKKF

SEQ ID NO: 25123 - protein, 8 aa, Homo sapiens
KFKGLKRF

SEQ ID NO: 25124 - protein, 12 aa, Homo sapiens
RYNESDKQMKKF

SEQ ID NO: 25125 - protein, 12 aa, Homo sapiens
RYNESDKQMKKF

SEQ ID NO: 25126 - protein, 12 aa, Homo sapiens
RYNESDKQMKKF

SEQ ID NO: 25127 - protein, 12 aa, Homo sapiens
RYNESDKQMKKF

SEQ ID NO: 25128 - protein, 12 aa, Homo sapiens
RYNESDKQMKKF

SEQ ID NO: 25129 - protein, 12 aa, Homo sapiens
RYNESDKQMKKF

SEQ ID NO: 25130 - protein, 8 aa, Homo sapiens
KFKGLKRF

SEQ ID NO: 25131 - protein, 8 aa, Homo sapiens
KFKGLKRF

SEQ ID NO: 25132 - protein, 12 aa, Homo sapiens
RYNESDKQMKKF

SEQ ID NO: 25133 - protein, 8 aa, Homo sapiens
KFKGLKRF

SEQ ID NO: 25134 - protein, 8 aa, Homo sapiens
KFKGLKRF

SEQ ID NO: 25135 - protein, 7 aa, Homo sapiens
KFKGLKR

SEQ ID NO: 25136 - protein, 8 aa, Homo sapiens
KFKGLKRF

SEQ ID NO: 25137 - protein, 8 aa, Homo sapiens
KFKGLKRF

SEQ ID NO: 25138 - protein, 8 aa, Homo sapiens
KFKGLKRF

SEQ ID NO: 25139 - protein, 8 aa, Homo sapiens
KKKELARR

SEQ ID NO: 25140 - protein, 8 aa, Homo sapiens
KKKELARR

SEQ ID NO: 25141 - protein, 10 aa, Homo sapiens
RNPTSKYYRN

SEQ ID NO: 25142 - protein, 8 aa, Homo sapiens
KKKELARR

SEQ ID NO: 25143 - protein, 14 aa, Homo sapiens
RLISELFQKLPSKV

SEQ ID NO: 25144 - protein, 14 aa, Homo sapiens
RLISELFQKLPSKV

SEQ ID NO: 25145 - protein, 14 aa, Homo sapiens
RLISELFQKLPSKV

SEQ ID NO: 25146 - protein, 14 aa, Homo sapiens
RLISELFQKLPSKV

SEQ ID NO: 25147 - protein, 14 aa, Homo sapiens
RLISELFQKLPSKV

SEQ ID NO: 25148 - protein, 14 aa, Homo sapiens
RLISELFQKLPSKV

SEQ ID NO: 25149 - protein, 14 aa, Homo sapiens
RLISELFQKLPSKV

SEQ ID NO: 25150 - protein, 14 aa, Homo sapiens
RLISELFQKLPSKV

SEQ ID NO: 25151 - protein, 14 aa, Homo sapiens
RLISELFQKLPSKV

SEQ ID NO: 25152 - protein, 14 aa, Homo sapiens
RLISELFQKLPSKV

SEQ ID NO: 25153 - protein, 13 aa, Homo sapiens
KEPIDLKTIAQRI

SEQ ID NO: 25154 - protein, 14 aa, Homo sapiens
RLISELFQKLPSKV

SEQ ID NO: 25155 - protein, 24 aa, Homo sapiens
KVQYPDYYAIIKEPIDLKTIAQRI

SEQ ID NO: 25156 - protein, 14 aa, Homo sapiens
RLISELFQKLPSKV

SEQ ID NO: 25157 - protein, 14 aa, Homo sapiens
RLISELFQKLPSKV

SEQ ID NO: 25158 - protein, 24 aa, Homo sapiens
KVQYPDYYAIIKEPIDLKTIAQRI

SEQ ID NO: 25159 - protein, 13 aa, Homo sapiens
RVLKLQQVMQAKK

SEQ ID NO: 25160 - protein, 8 aa, Homo sapiens
KKKELARR

SEQ ID NO: 25161 - protein, 8 aa, Homo sapiens
KLLKEKRK

SEQ ID NO: 25162 - protein, 7 aa, Homo sapiens
KLKLSRK

SEQ ID NO: 25163 - protein, 21 aa, Homo sapiens
REAEKSEDSSGAAGLSGLHRT

SEQ ID NO: 25164 - protein, 17 aa, Homo sapiens
KEVFKSDYYNKVPVSKI

SEQ ID NO: 25165 - protein, 17 aa, Homo sapiens
KEVFKSDYYNKVPVSKI

SEQ ID NO: 25166 - protein, 17 aa, Homo sapiens
KEVFKSDYYNKVPVSKI

SEQ ID NO: 25167 - protein, 16 aa, Homo sapiens
KAEIEHHEMAKSSLRM

SEQ ID NO: 25168 - protein, 11 aa, Homo sapiens
RYNESDKQMKK

SEQ ID NO: 25169 - protein, 12 aa, Homo sapiens
RYNESDKQMKKF

SEQ ID NO: 25170 - protein, 12 aa, Homo sapiens
RYNESDKQMKKF

SEQ ID NO: 25171 - protein, 11 aa, Homo sapiens
RYNESDKQMKK

SEQ ID NO: 25172 - protein, 11 aa, Homo sapiens
RYNESDKQMKK

SEQ ID NO: 25173 - protein, 11 aa, Homo sapiens
RYNESDKQMKK

SEQ ID NO: 25174 - protein, 25 aa, Homo sapiens
RRDDIEDGDSMISSATSDTGSAKRK

SEQ ID NO: 25175 - protein, 9 aa, Homo sapiens
RKSGISPKK

SEQ ID NO: 25176 - protein, 17 aa, Homo sapiens
KLNEVYEAVKNYTDKRG

SEQ ID NO: 25177 - protein, 17 aa, Homo sapiens
KLNEVYEAVKNYTDKRG

SEQ ID NO: 25178 - protein, 9 aa, Homo sapiens
KKAEYEERA

SEQ ID NO: 25179 - protein, 9 aa, Homo sapiens
KKAEYEERA

SEQ ID NO: 25180 - protein, 14 aa, Homo sapiens
RAAKVAEQQERERA

SEQ ID NO: 25181 - protein, 9 aa, Homo sapiens
KKAEYEERA

SEQ ID NO: 25182 - protein, 9 aa, Homo sapiens
KKAEYEERA

SEQ ID NO: 25183 - protein, 19 aa, Homo sapiens
RAVIKAQHPDYSFGELSRL

SEQ ID NO: 25184 - protein, 8 aa, Homo sapiens
KKEGSKRK

SEQ ID NO: 25185 - protein, 21 aa, Homo sapiens
REAEKSEDSSGAAGLSGLHRT

SEQ ID NO: 25186 - protein, 8 aa, Homo sapiens
KREEEKRE

SEQ ID NO: 25187 - protein, 8 aa, Homo sapiens
KREEEKRE

SEQ ID NO: 25188 - protein, 8 aa, Homo sapiens
KREEEKRE

SEQ ID NO: 25189 - protein, 8 aa, Homo sapiens
KREEEKRE

SEQ ID NO: 25190 - protein, 7 aa, Homo sapiens
REEEKRE

SEQ ID NO: 25191 - protein, 7 aa, Homo sapiens
REEEKRE

SEQ ID NO: 25192 - protein, 8 aa, Homo sapiens
KREEEKRE

SEQ ID NO: 25193 - protein, 7 aa, Homo sapiens
KLKLSRK

SEQ ID NO: 25194 - protein, 7 aa, Homo sapiens
KLKLSRK

SEQ ID NO: 25195 - protein, 6 aa, Homo sapiens
KKNIRK

SEQ ID NO: 25196 - protein, 16 aa, Homo sapiens
KSKGAHTTMADALWRL

SEQ ID NO: 25197 - protein, 16 aa, Homo sapiens
KSKGAHTTMADALWRL

SEQ ID NO: 25198 - protein, 11 aa, Homo sapiens
RLPSHWLKSKG

SEQ ID NO: 25199 - protein, 7 aa, Homo sapiens
KKELARR

SEQ ID NO: 25200 - protein, 17 aa, Homo sapiens
RLTGPSHSKGSLGEERN

SEQ ID NO: 25201 - protein, 10 aa, Homo sapiens
RNPTSKYYRN

SEQ ID NO: 25202 - protein, 17 aa, Homo sapiens
RLTGPSHSKGSLGEERN

SEQ ID NO: 25203 - protein, 17 aa, Homo sapiens
RLTGPSHSKGSLGEERN

SEQ ID NO: 25204 - protein, 10 aa, Homo sapiens
RNPTSKYYRN

SEQ ID NO: 25205 - protein, 10 aa, Homo sapiens
RNPTSKYYRN

SEQ ID NO: 25206 - protein, 10 aa, Homo sapiens
RNPTSKYYRN

SEQ ID NO: 25207 - protein, 17 aa, Homo sapiens
RLTGPSHSKGSLGEERN

SEQ ID NO: 25208 - protein, 10 aa, Homo sapiens
RNPTSKYYRN

SEQ ID NO: 25209 - protein, 17 aa, Homo sapiens
RLTGPSHSKGSLGEERN

SEQ ID NO: 25210 - protein, 17 aa, Homo sapiens
RLTGPSHSKGSLGEERN

SEQ ID NO: 25211 - protein, 17 aa, Homo sapiens
RLTGPSHSKGSLGEERN

SEQ ID NO: 25212 - protein, 17 aa, Homo sapiens
RLTGPSHSKGSLGEERN

SEQ ID NO: 25213 - protein, 17 aa, Homo sapiens
RLTGPSHSKGSLGEERN

SEQ ID NO: 25214 - protein, 13 aa, Homo sapiens
RVLKLQQVMQAKK

SEQ ID NO: 25215 - protein, 17 aa, Homo sapiens
RLTGPSHSKGSLGEERN

SEQ ID NO: 25216 - protein, 7 aa, Homo sapiens
KLKLSRK

SEQ ID NO: 25217 - protein, 8 aa, Homo sapiens
KKKELARR

SEQ ID NO: 25218 - protein, 13 aa, Homo sapiens
RVLKLQQVMQAKK

SEQ ID NO: 25219 - protein, 13 aa, Homo sapiens
RVLKLQQVMQAKK

SEQ ID NO: 25220 - protein, 25 aa, Homo sapiens
RRDDIEDGDSMISSATSDTGSAKRK

SEQ ID NO: 25221 - protein, 25 aa, Homo sapiens
RRDDIEDGDSMISSATSDTGSAKRK

SEQ ID NO: 25222 - protein, 25 aa, Homo sapiens
RRDDIEDGDSMISSATSDTGSAKRK

SEQ ID NO: 25223 - protein, 25 aa, Homo sapiens
RRDDIEDGDSMISSATSDTGSAKRK

SEQ ID NO: 25224 - protein, 25 aa, Homo sapiens
RRDDIEDGDSMISSATSDTGSAKRK

SEQ ID NO: 25225 - protein, 14 aa, Homo sapiens
RVLKLQQVMQAKKK

SEQ ID NO: 25226 - protein, 14 aa, Homo sapiens
RVLKLQQVMQAKKK

SEQ ID NO: 25227 - protein, 8 aa, Homo sapiens
KKKELARR

SEQ ID NO: 25228 - protein, 13 aa, Homo sapiens
RVLKLQQVMQAKK

SEQ ID NO: 25229 - protein, 13 aa, Homo sapiens
RVLKLQQVMQAKK

SEQ ID NO: 25230 - protein, 8 aa, Homo sapiens
KKKELARR

SEQ ID NO: 25231 - protein, 8 aa, Homo sapiens
KKKELARR

SEQ ID NO: 25232 - protein, 19 aa, Homo sapiens
RAVIKAQHPDYSFGELSRL

SEQ ID NO: 25233 - protein, 19 aa, Homo sapiens
RAVIKAQHPDYSFGELSRL

SEQ ID NO: 25234 - protein, 19 aa, Homo sapiens
RAVIKAQHPDYSFGELSRL

SEQ ID NO: 25235 - protein, 19 aa, Homo sapiens
RAVIKAQHPDYSFGELSRL

SEQ ID NO: 25236 - protein, 13 aa, Homo sapiens
RDVHLSKEQESRL

SEQ ID NO: 25237 - protein, 19 aa, Homo sapiens
RAVIKAQHPDYSFGELSRL

SEQ ID NO: 25238 - protein, 9 aa, Homo sapiens
RNLETAKKA

SEQ ID NO: 25239 - protein, 12 aa, Homo sapiens
RAAKVAEQQERE

SEQ ID NO: 25240 - protein, 12 aa, Homo sapiens
RAAKVAEQQERE

SEQ ID NO: 25241 - protein, 12 aa, Homo sapiens
RAAKVAEQQERE

SEQ ID NO: 25242 - protein, 9 aa, Homo sapiens
KKAEYEERA

SEQ ID NO: 25243 - protein, 9 aa, Homo sapiens
KKAEYEERA

SEQ ID NO: 25244 - protein, 18 aa, Homo sapiens
KDYPDYYKIILEPMDLKI

SEQ ID NO: 25245 - protein, 19 aa, Homo sapiens
KKDYPDYYKIILEPMDLKI

SEQ ID NO: 25246 - protein, 13 aa, Homo sapiens
RLCDLFMVKPSKK

SEQ ID NO: 25247 - protein, 13 aa, Homo sapiens
RLCDLFMVKPSKK

SEQ ID NO: 25248 - protein, 10 aa, Homo sapiens
KKDYPDYYKI

SEQ ID NO: 25249 - protein, 10 aa, Homo sapiens
KKDYPDYYKI

SEQ ID NO: 25250 - protein, 13 aa, Homo sapiens
RLCDLFMVKPSKK

SEQ ID NO: 25251 - protein, 13 aa, Homo sapiens
RLCDLFMVKPSKK

SEQ ID NO: 25252 - protein, 13 aa, Homo sapiens
RLCDLFMVKPSKK

SEQ ID NO: 25253 - protein, 10 aa, Homo sapiens
KKDYPDYYKI

SEQ ID NO: 25254 - protein, 14 aa, Homo sapiens
RRLCDLFMVKPSKK

SEQ ID NO: 25255 - protein, 13 aa, Homo sapiens
RLCDLFMVKPSKK

SEQ ID NO: 25256 - protein, 10 aa, Homo sapiens
KKDYPDYYKI

SEQ ID NO: 25257 - protein, 10 aa, Homo sapiens
KKDYPDYYKI

SEQ ID NO: 25258 - protein, 14 aa, Homo sapiens
RRLCDLFMVKPSKK

SEQ ID NO: 25259 - protein, 17 aa, Homo sapiens
RKPIVPQKEPSPLLEKK

SEQ ID NO: 25260 - protein, 17 aa, Homo sapiens
RKPIVPQKEPSPLLEKK

SEQ ID NO: 25261 - protein, 15 aa, Homo sapiens
RLTCEEEEEKMFGRG

SEQ ID NO: 25262 - protein, 12 aa, Homo sapiens
RLDGTTKAEDRG

SEQ ID NO: 25263 - protein, 10 aa, Homo sapiens
KYKLNVDQKV

SEQ ID NO: 25264 - protein, 10 aa, Homo sapiens
KYKLNVDQKV

SEQ ID NO: 25265 - protein, 17 aa, Homo sapiens
RDTALETALNAKAYKRS

SEQ ID NO: 25266 - protein, 17 aa, Homo sapiens
RDTALETALNAKAYKRS

SEQ ID NO: 25267 - protein, 17 aa, Homo sapiens
RDTALETALNAKAYKRS

SEQ ID NO: 25268 - protein, 17 aa, Homo sapiens
RDTALETALNAKAYKRS

SEQ ID NO: 25269 - protein, 9 aa, Homo sapiens
RKEKAQDRL

SEQ ID NO: 25270 - protein, 9 aa, Homo sapiens
RKEKAQDRL

SEQ ID NO: 25271 - protein, 9 aa, Homo sapiens
RKEKAQDRL

SEQ ID NO: 25272 - protein, 9 aa, Homo sapiens
RKEKAQDRL

SEQ ID NO: 25273 - protein, 9 aa, Homo sapiens
RKEKAQDRL

SEQ ID NO: 25274 - protein, 9 aa, Homo sapiens
RKEKAQDRL

SEQ ID NO: 25275 - protein, 7 aa, Homo sapiens
KIKLGRK

SEQ ID NO: 25276 - protein, 9 aa, Homo sapiens
RKEKAQDRL

SEQ ID NO: 25277 - protein, 7 aa, Homo sapiens
KIKLGRK

SEQ ID NO: 25278 - protein, 7 aa, Homo sapiens
KIKLGRK

SEQ ID NO: 25279 - protein, 9 aa, Homo sapiens
KVKIKLGRK

SEQ ID NO: 25280 - protein, 8 aa, Homo sapiens
KIKLGRKE

SEQ ID NO: 25281 - protein, 8 aa, Homo sapiens
KIKLGRKE

SEQ ID NO: 25282 - protein, 9 aa, Homo sapiens
RKEKAQDRL

SEQ ID NO: 25283 - protein, 9 aa, Homo sapiens
RKEKAQDRL

SEQ ID NO: 25284 - protein, 11 aa, Homo sapiens
KQQKIEQERKR

SEQ ID NO: 25285 - protein, 18 aa, Homo sapiens
RKRDSDAGSSTPTTSTRS

SEQ ID NO: 25286 - protein, 9 aa, Homo sapiens
KVKIKLGRK

SEQ ID NO: 25287 - protein, 9 aa, Homo sapiens
RKEKAQDRL

SEQ ID NO: 25288 - protein, 9 aa, Homo sapiens
RKEKAQDRL

SEQ ID NO: 25289 - protein, 9 aa, Homo sapiens
RKEKAQDRL

SEQ ID NO: 25290 - protein, 19 aa, Homo sapiens
KKKIPDPDSDDVSEVDARH

SEQ ID NO: 25291 - protein, 19 aa, Homo sapiens
KVIHVESGKILTGTDAPKA

SEQ ID NO: 25292 - protein, 22 aa, Homo sapiens
RLMEEDELPSWIIKDDAEVERL

SEQ ID NO: 25293 - protein, 22 aa, Homo sapiens
RLMEEDELPSWIIKDDAEVERL

SEQ ID NO: 25294 - protein, 22 aa, Homo sapiens
RLMEEDELPSWIIKDDAEVERL

SEQ ID NO: 25295 - protein, 22 aa, Homo sapiens
RLMEEDELPSWIIKDDAEVERL

SEQ ID NO: 25296 - protein, 19 aa, Homo sapiens
KKKIPDPDSDDVSEVDARH

SEQ ID NO: 25297 - protein, 24 aa, Homo sapiens
RHIIENAKQDVDDEYGVSQALARG

SEQ ID NO: 25298 - protein, 12 aa, Homo sapiens
KVSYKGSPAARR

SEQ ID NO: 25299 - protein, 13 aa, Homo sapiens
RKELPEYYELIRK

SEQ ID NO: 25300 - protein, 16 aa, Homo sapiens
KLTKAVATYHANTERE

SEQ ID NO: 25301 - protein, 25 aa, Homo sapiens
RELFQEMNIELVPPYMIASKEAVRE

SEQ ID NO: 25302 - protein, 11 aa, Homo sapiens
RKEKLPQVTRS

SEQ ID NO: 25303 - protein, 11 aa, Homo sapiens
RKEKLPQVTRS

SEQ ID NO: 25304 - protein, 25 aa, Homo sapiens
RELFQEMNIELVPPYMIASKEAVRE

SEQ ID NO: 25305 - protein, 22 aa, Homo sapiens
REKLTELMFEHYNIPAFFLCKT

SEQ ID NO: 25306 - protein, 22 aa, Homo sapiens
REKLTELMFEHYNIPAFFLCKT

SEQ ID NO: 25307 - protein, 22 aa, Homo sapiens
REKLTELMFEHYNIPAFFLCKT

SEQ ID NO: 25308 - protein, 22 aa, Homo sapiens
REKLTELMFEHYNIPAFFLCKT

SEQ ID NO: 25309 - protein, 22 aa, Homo sapiens
REKLTELMFEHYNIPAFFLCKT

SEQ ID NO: 25310 - protein, 15 aa, Homo sapiens
KQEYEEGGKQCVERK

SEQ ID NO: 25311 - protein, 15 aa, Homo sapiens
KQEYEEGGKQCVERK

SEQ ID NO: 25312 - protein, 11 aa, Homo sapiens
RKEKLPQVTRS

SEQ ID NO: 25313 - protein, 11 aa, Homo sapiens
REGSPANWKRK

SEQ ID NO: 25314 - protein, 11 aa, Homo sapiens
REGSPANWKRK

SEQ ID NO: 25315 - protein, 11 aa, Homo sapiens
RKEKLPQVTRS

SEQ ID NO: 25316 - protein, 11 aa, Homo sapiens
RKEKLPQVTRS

SEQ ID NO: 25317 - protein, 11 aa, Homo sapiens
RKEKLPQVTRS

SEQ ID NO: 25318 - protein, 11 aa, Homo sapiens
RKEKLPQVTRS

SEQ ID NO: 25319 - protein, 11 aa, Homo sapiens
REGSPANWKRK

SEQ ID NO: 25320 - protein, 11 aa, Homo sapiens
REGSPANWKRK

SEQ ID NO: 25321 - protein, 11 aa, Homo sapiens
RKEKLPQVTRS

SEQ ID NO: 25322 - protein, 11 aa, Homo sapiens
RKEKLPQVTRS

SEQ ID NO: 25323 - protein, 11 aa, Homo sapiens
RKEKLPQVTRS

SEQ ID NO: 25324 - protein, 11 aa, Homo sapiens
RKEKLPQVTRS

SEQ ID NO: 25325 - protein, 11 aa, Homo sapiens
RKEKLPQVTRS

SEQ ID NO: 25326 - protein, 11 aa, Homo sapiens
RKEKLPQVTRS

SEQ ID NO: 25327 - protein, 11 aa, Homo sapiens
RKEKLPQVTRS

SEQ ID NO: 25328 - protein, 11 aa, Homo sapiens
RKEKLPQVTRS

SEQ ID NO: 25329 - protein, 11 aa, Homo sapiens
RKEKLPQVTRS

SEQ ID NO: 25330 - protein, 11 aa, Homo sapiens
RKEKLPQVTRS

SEQ ID NO: 25331 - protein, 11 aa, Homo sapiens
RKEKLPQVTRS

SEQ ID NO: 25332 - protein, 15 aa, Homo sapiens
KEAVREGSPANWKRK

SEQ ID NO: 25333 - protein, 11 aa, Homo sapiens
RKEKLPQVTRS

SEQ ID NO: 25334 - protein, 11 aa, Homo sapiens
RKEKLPQVTRS

SEQ ID NO: 25335 - protein, 11 aa, Homo sapiens
REGSPANWKRK

SEQ ID NO: 25336 - protein, 11 aa, Homo sapiens
RKEKLPQVTRS

SEQ ID NO: 25337 - protein, 11 aa, Homo sapiens
RKEKLPQVTRS

SEQ ID NO: 25338 - protein, 11 aa, Homo sapiens
RKEKLPQVTRS

SEQ ID NO: 25339 - protein, 11 aa, Homo sapiens
RKEKLPQVTRS

SEQ ID NO: 25340 - protein, 11 aa, Homo sapiens
RKEKLPQVTRS

SEQ ID NO: 25341 - protein, 11 aa, Homo sapiens
RKEKLPQVTRS

SEQ ID NO: 25342 - protein, 11 aa, Homo sapiens
RKEKLPQVTRS

SEQ ID NO: 25343 - protein, 11 aa, Homo sapiens
RKEKLPQVTRS

SEQ ID NO: 25344 - protein, 11 aa, Homo sapiens
KVMATIEKVRR

SEQ ID NO: 25345 - protein, 10 aa, Homo sapiens
KKVMATIEKV

SEQ ID NO: 25346 - protein, 10 aa, Homo sapiens
KKVMATIEKV

SEQ ID NO: 25347 - protein, 13 aa, Homo sapiens
RIYKWVPVTEPKV

SEQ ID NO: 25348 - protein, 11 aa, Homo sapiens
RVMAAIEKVRK

SEQ ID NO: 25349 - protein, 11 aa, Homo sapiens
RVMAAIEKVRK

SEQ ID NO: 25350 - protein, 11 aa, Homo sapiens
RVMAAIEKVRK

SEQ ID NO: 25351 - protein, 11 aa, Homo sapiens
RVMAAIEKVRK

SEQ ID NO: 25352 - protein, 6 aa, Homo sapiens
RKWEKK

SEQ ID NO: 25353 - protein, 9 aa, Homo sapiens
RAKDDIKRV

SEQ ID NO: 25354 - protein, 11 aa, Homo sapiens
RVMAAIEKVRK

SEQ ID NO: 25355 - protein, 11 aa, Homo sapiens
RVMAAIEKVRK

SEQ ID NO: 25356 - protein, 11 aa, Homo sapiens
RVMAAIEKVRK

SEQ ID NO: 25357 - protein, 11 aa, Homo sapiens
RVMAAIEKVRK

SEQ ID NO: 25358 - protein, 9 aa, Homo sapiens
RAKDDIKRV

SEQ ID NO: 25359 - protein, 11 aa, Homo sapiens
RVMAAIEKVRK

SEQ ID NO: 25360 - protein, 9 aa, Homo sapiens
RAKDDIKRV

SEQ ID NO: 25361 - protein, 9 aa, Homo sapiens
RAKDDIKRV

SEQ ID NO: 25362 - protein, 11 aa, Homo sapiens
RVMAAIEKVRK

SEQ ID NO: 25363 - protein, 9 aa, Homo sapiens
RAKDDIKRV

SEQ ID NO: 25364 - protein, 13 aa, Homo sapiens
KKWVTVGDTSLRI

SEQ ID NO: 25365 - protein, 14 aa, Homo sapiens
RDFTDEKEGPITKH

SEQ ID NO: 25366 - protein, 14 aa, Homo sapiens
RDFTDEKEGPITKH

SEQ ID NO: 25367 - protein, 8 aa, Homo sapiens
RGSPFKKI

SEQ ID NO: 25368 - protein, 18 aa, Homo sapiens
KSSTKQPTVGGTSSTPRA

SEQ ID NO: 25369 - protein, 18 aa, Homo sapiens
KSSTKQPTVGGTSSTPRA

SEQ ID NO: 25370 - protein, 19 aa, Homo sapiens
RAQKAIVNHPSAALMALRR

SEQ ID NO: 25371 - protein, 18 aa, Homo sapiens
KSSTKQPTVGGTSSTPRA

SEQ ID NO: 25372 - protein, 19 aa, Homo sapiens
RAQKAIVNHPSAALMALRR

SEQ ID NO: 25373 - protein, 18 aa, Homo sapiens
KSSTKQPTVGGTSSTPRA

SEQ ID NO: 25374 - protein, 18 aa, Homo sapiens
KSSTKQPTVGGTSSTPRA

SEQ ID NO: 25375 - protein, 9 aa, Homo sapiens
RKFSSFFKS

SEQ ID NO: 25376 - protein, 9 aa, Homo sapiens
RKFSSFFKS

SEQ ID NO: 25377 - protein, 9 aa, Homo sapiens
RKFSSFFKS

SEQ ID NO: 25378 - protein, 12 aa, Homo sapiens
KLLDDPSKQKRK

SEQ ID NO: 25379 - protein, 10 aa, Homo sapiens
KRKFSSFFKS

SEQ ID NO: 25380 - protein, 9 aa, Homo sapiens
RKFSSFFKS

SEQ ID NO: 25381 - protein, 9 aa, Homo sapiens
RKFSSFFKS

SEQ ID NO: 25382 - protein, 12 aa, Homo sapiens
RKRMEIQEAIKK

SEQ ID NO: 25383 - protein, 17 aa, Homo sapiens
KIHETIESINQLKTQRD

SEQ ID NO: 25384 - protein, 8 aa, Homo sapiens
KPLTQKRK

SEQ ID NO: 25385 - protein, 8 aa, Homo sapiens
KPLTQKRK

SEQ ID NO: 25386 - protein, 10 aa, Homo sapiens
KYDATKQKRK

SEQ ID NO: 25387 - protein, 23 aa, Homo sapiens
RTATTQETDGFQVKRPGDVNVRC

SEQ ID NO: 25388 - protein, 11 aa, Homo sapiens
RYFYSKVQQRR

SEQ ID NO: 25389 - protein, 11 aa, Homo sapiens
RYFYSKVQQRR

SEQ ID NO: 25390 - protein, 21 aa, Homo sapiens
RKRPAPQQIQQVQQQAVQNRN

SEQ ID NO: 25391 - protein, 10 aa, Homo sapiens
RKLDQTIMRK

SEQ ID NO: 25392 - protein, 7 aa, Homo sapiens
RPIKQKR

SEQ ID NO: 25393 - protein, 7 aa, Homo sapiens
RPIKQKR

SEQ ID NO: 25394 - protein, 18 aa, Homo sapiens
RDLKTMTDVVGNPEEERR

SEQ ID NO: 25395 - protein, 11 aa, Homo sapiens
KMADKILPQRI

SEQ ID NO: 25396 - protein, 12 aa, Homo sapiens
EKPTDMQNFGLR

SEQ ID NO: 25397 - protein, 19 aa, Homo sapiens
TPQQTSASQQMLNFPDKGK

SEQ ID NO: 25398 - protein, 19 aa, Homo sapiens
TPQQTSASQQMLNFPDKGK

SEQ ID NO: 25399 - protein, 19 aa, Homo sapiens
TPQQTSASQQMLNFPDKGK

SEQ ID NO: 25400 - protein, 12 aa, Homo sapiens
EKPTDMQNFGLR

SEQ ID NO: 25401 - protein, 12 aa, Homo sapiens
EKPTDMQNFGLR

SEQ ID NO: 25402 - protein, 12 aa, Homo sapiens
EKPTDMQNFGLR

SEQ ID NO: 25403 - protein, 12 aa, Homo sapiens
EKPTDMQNFGLR

SEQ ID NO: 25404 - protein, 19 aa, Homo sapiens
TPQQTSASQQMLNFPDKGK

SEQ ID NO: 25405 - protein, 19 aa, Homo sapiens
TPQQTSASQQMLNFPDKGK

SEQ ID NO: 25406 - protein, 12 aa, Homo sapiens
TDMYTKKNVPSK

SEQ ID NO: 25407 - protein, 12 aa, Homo sapiens
TDMYTKKNVPSK

SEQ ID NO: 25408 - protein, 12 aa, Homo sapiens
TDMYTKKNVPSK

SEQ ID NO: 25409 - protein, 12 aa, Homo sapiens
TDMYTKKNVPSK

SEQ ID NO: 25410 - protein, 12 aa, Homo sapiens
TDMYTKKNVPSK

SEQ ID NO: 25411 - protein, 9 aa, Homo sapiens
SKAAASATR

SEQ ID NO: 25412 - protein, 12 aa, Homo sapiens
TDMYTKKNVPSK

SEQ ID NO: 25413 - protein, 7 aa, Homo sapiens
TDMYTKK

SEQ ID NO: 25414 - protein, 12 aa, Homo sapiens
TDMYTKKNVPSK

SEQ ID NO: 25415 - protein, 7 aa, Homo sapiens
TDMYTKK

SEQ ID NO: 25416 - protein, 7 aa, Homo sapiens
TDMYTKK

SEQ ID NO: 25417 - protein, 9 aa, Homo sapiens
SKAAASATR

SEQ ID NO: 25418 - protein, 8 aa, Homo sapiens
EKTSEAPK

SEQ ID NO: 25419 - protein, 6 aa, Homo sapiens
EPKEPR

SEQ ID NO: 25420 - protein, 6 aa, Homo sapiens
EPKEPR

SEQ ID NO: 25421 - protein, 10 aa, Homo sapiens
VEGQATDEKK

SEQ ID NO: 25422 - protein, 6 aa, Homo sapiens
EPKEPR

SEQ ID NO: 25423 - protein, 6 aa, Homo sapiens
EPKEPR

SEQ ID NO: 25424 - protein, 6 aa, Homo sapiens
EPKEPR

SEQ ID NO: 25425 - protein, 6 aa, Homo sapiens
EPKEPR

SEQ ID NO: 25426 - protein, 6 aa, Homo sapiens
EPKEPR

SEQ ID NO: 25427 - protein, 6 aa, Homo sapiens
EPKEPR

SEQ ID NO: 25428 - protein, 10 aa, Homo sapiens
VEGQATDEKK

SEQ ID NO: 25429 - protein, 10 aa, Homo sapiens
VEGQATDEKK

SEQ ID NO: 25430 - protein, 6 aa, Homo sapiens
EPKEPR

SEQ ID NO: 25431 - protein, 10 aa, Homo sapiens
VEGQATDEKK

SEQ ID NO: 25432 - protein, 6 aa, Homo sapiens
EPKEPR

SEQ ID NO: 25433 - protein, 17 aa, Homo sapiens
EGQEEVLKEVVESEGER

SEQ ID NO: 25434 - protein, 6 aa, Homo sapiens
KTKVER

SEQ ID NO: 25435 - protein, 6 aa, Homo sapiens
KTKVER

SEQ ID NO: 25436 - protein, 17 aa, Homo sapiens
EGQEEVLKEVVESEGER

SEQ ID NO: 25437 - protein, 6 aa, Homo sapiens
KTKVER

SEQ ID NO: 25438 - protein, 6 aa, Homo sapiens
KTKVER

SEQ ID NO: 25439 - protein, 17 aa, Homo sapiens
EGQEEVLKEVVESEGER

SEQ ID NO: 25440 - protein, 6 aa, Homo sapiens
KTKVER

SEQ ID NO: 25441 - protein, 17 aa, Homo sapiens
EGQEEVLKEVVESEGER

SEQ ID NO: 25442 - protein, 6 aa, Homo sapiens
KTKVER

SEQ ID NO: 25443 - protein, 6 aa, Homo sapiens
KTKVER

SEQ ID NO: 25444 - protein, 17 aa, Homo sapiens
EGQEEVLKEVVESEGER

SEQ ID NO: 25445 - protein, 6 aa, Homo sapiens
KTKVER

SEQ ID NO: 25446 - protein, 6 aa, Homo sapiens
KTKVER

SEQ ID NO: 25447 - protein, 5 aa, Homo sapiens
TKVER

SEQ ID NO: 25448 - protein, 17 aa, Homo sapiens
EGQEEVLKEVVESEGER

SEQ ID NO: 25449 - protein, 17 aa, Homo sapiens
EGQEEVLKEVVESEGER

SEQ ID NO: 25450 - protein, 6 aa, Homo sapiens
KTKVER

SEQ ID NO: 25451 - protein, 17 aa, Homo sapiens
EGQEEVLKEVVESEGER

SEQ ID NO: 25452 - protein, 6 aa, Homo sapiens
KTKVER

SEQ ID NO: 25453 - protein, 10 aa, Homo sapiens
AKHLAAVEER

SEQ ID NO: 25454 - protein, 10 aa, Homo sapiens
AKHLAAVEER

SEQ ID NO: 25455 - protein, 10 aa, Homo sapiens
AKHLAAVEER

SEQ ID NO: 25456 - protein, 15 aa, Homo sapiens
VASAAAKSALEEFSK

SEQ ID NO: 25457 - protein, 15 aa, Homo sapiens
MKEEVPTALVEAHVR

SEQ ID NO: 25458 - protein, 15 aa, Homo sapiens
VASAAAKSALEEFSK

SEQ ID NO: 25459 - protein, 15 aa, Homo sapiens
VASAAAKSALEEFSK

SEQ ID NO: 25460 - protein, 15 aa, Homo sapiens
VASAAAKSALEEFSK

SEQ ID NO: 25461 - protein, 15 aa, Homo sapiens
VASAAAKSALEEFSK

SEQ ID NO: 25462 - protein, 15 aa, Homo sapiens
VASAAAKSALEEFSK

SEQ ID NO: 25463 - protein, 15 aa, Homo sapiens
VASAAAKSALEEFSK

SEQ ID NO: 25464 - protein, 15 aa, Homo sapiens
MKEEVPTALVEAHVR

SEQ ID NO: 25465 - protein, 15 aa, Homo sapiens
VASAAAKSALEEFSK

SEQ ID NO: 25466 - protein, 15 aa, Homo sapiens
VASAAAKSALEEFSK

SEQ ID NO: 25467 - protein, 15 aa, Homo sapiens
VASAAAKSALEEFSK

SEQ ID NO: 25468 - protein, 15 aa, Homo sapiens
MKEEVPTALVEAHVR

SEQ ID NO: 25469 - protein, 15 aa, Homo sapiens
MKEEVPTALVEAHVR

SEQ ID NO: 25470 - protein, 15 aa, Homo sapiens
MKEEVPTALVEAHVR

SEQ ID NO: 25471 - protein, 15 aa, Homo sapiens
MKEEVPTALVEAHVR

SEQ ID NO: 25472 - protein, 15 aa, Homo sapiens
MKEEVPTALVEAHVR

SEQ ID NO: 25473 - protein, 15 aa, Homo sapiens
MKEEVPTALVEAHVR

SEQ ID NO: 25474 - protein, 15 aa, Homo sapiens
VASAAAKSALEEFSK

SEQ ID NO: 25475 - protein, 15 aa, Homo sapiens
VASAAAKSALEEFSK

SEQ ID NO: 25476 - protein, 7 aa, Homo sapiens
KVEEAAK

SEQ ID NO: 25477 - protein, 7 aa, Homo sapiens
KVEEAAK

SEQ ID NO: 25478 - protein, 7 aa, Homo sapiens
KVEEAAK

SEQ ID NO: 25479 - protein, 6 aa, Homo sapiens
KTKVER

SEQ ID NO: 25480 - protein, 6 aa, Homo sapiens
KTKVER

SEQ ID NO: 25481 - protein, 15 aa, Homo sapiens
VASAAAKSALEEFSK

SEQ ID NO: 25482 - protein, 7 aa, Homo sapiens
KVEEAAK

SEQ ID NO: 25483 - protein, 7 aa, Homo sapiens
KVEEAAK

SEQ ID NO: 25484 - protein, 7 aa, Homo sapiens
KVEEAAK

SEQ ID NO: 25485 - protein, 7 aa, Homo sapiens
KVEEAAK

SEQ ID NO: 25486 - protein, 7 aa, Homo sapiens
KVEEAAK

SEQ ID NO: 25487 - protein, 6 aa, Homo sapiens
KTKVER

SEQ ID NO: 25488 - protein, 6 aa, Homo sapiens
KTKVER

SEQ ID NO: 25489 - protein, 6 aa, Homo sapiens
KTKVER

SEQ ID NO: 25490 - protein, 6 aa, Homo sapiens
KTKVER

SEQ ID NO: 25491 - protein, 20 aa, Homo sapiens
EEVPTALVEAHVRKVEEAAK

SEQ ID NO: 25492 - protein, 5 aa, Homo sapiens
TKVER

SEQ ID NO: 25493 - protein, 7 aa, Homo sapiens
KVEEAAK

SEQ ID NO: 25494 - protein, 7 aa, Homo sapiens
KVEEAAK

SEQ ID NO: 25495 - protein, 9 aa, Homo sapiens
SKAAASATR

SEQ ID NO: 25496 - protein, 9 aa, Homo sapiens
SKAAASATR

SEQ ID NO: 25497 - protein, 11 aa, Homo sapiens
TSEAPKKDEEK

SEQ ID NO: 25498 - protein, 11 aa, Homo sapiens
TSEAPKKDEEK

SEQ ID NO: 25499 - protein, 11 aa, Homo sapiens
TSEAPKKDEEK

SEQ ID NO: 25500 - protein, 11 aa, Homo sapiens
TSEAPKKDEEK

SEQ ID NO: 25501 - protein, 5 aa, Homo sapiens
KDEEK

SEQ ID NO: 25502 - protein, 13 aa, Homo sapiens
EGGGAIEEEAKEK

SEQ ID NO: 25503 - protein, 11 aa, Homo sapiens
TSEAPKKDEEK

SEQ ID NO: 25504 - protein, 13 aa, Homo sapiens
EGGGAIEEEAKEK

SEQ ID NO: 25505 - protein, 19 aa, Homo sapiens
EGGGAIEEEAKEKTSEAPK

SEQ ID NO: 25506 - protein, 11 aa, Homo sapiens
TSEAPKKDEEK

SEQ ID NO: 25507 - protein, 11 aa, Homo sapiens
KVEEAAKVTGK

SEQ ID NO: 25508 - protein, 11 aa, Homo sapiens
KVEEAAKVTGK

SEQ ID NO: 25509 - protein, 5 aa, Homo sapiens
TKVER

SEQ ID NO: 25510 - protein, 5 aa, Homo sapiens
TKVER

SEQ ID NO: 25511 - protein, 11 aa, Homo sapiens
KVEEAAKVTGK

SEQ ID NO: 25512 - protein, 15 aa, Homo sapiens
MKEEVPTALVEAHVR

SEQ ID NO: 25513 - protein, 12 aa, Homo sapiens
TDMYTKKNVPSK

SEQ ID NO: 25514 - protein, 12 aa, Homo sapiens
TDMYTKKNVPSK

SEQ ID NO: 25515 - protein, 6 aa, Homo sapiens
KNVPSK

SEQ ID NO: 25516 - protein, 6 aa, Homo sapiens
KNVPSK

SEQ ID NO: 25517 - protein, 6 aa, Homo sapiens
KNVPSK

SEQ ID NO: 25518 - protein, 6 aa, Homo sapiens
KNVPSK

SEQ ID NO: 25519 - protein, 12 aa, Homo sapiens
EKPTDMQNFGLR

SEQ ID NO: 25520 - protein, 12 aa, Homo sapiens
EKPTDMQNFGLR

SEQ ID NO: 25521 - protein, 12 aa, Homo sapiens
EKPTDMQNFGLR

SEQ ID NO: 25522 - protein, 15 aa, Homo sapiens
MKEEVPTALVEAHVR

SEQ ID NO: 25523 - protein, 10 aa, Homo sapiens
AKHLAAVEER

SEQ ID NO: 25524 - protein, 15 aa, Homo sapiens
MKEEVPTALVEAHVR

SEQ ID NO: 25525 - protein, 10 aa, Homo sapiens
AKHLAAVEER

SEQ ID NO: 25526 - protein, 15 aa, Homo sapiens
MKEEVPTALVEAHVR

SEQ ID NO: 25527 - protein, 10 aa, Homo sapiens
AKHLAAVEER

SEQ ID NO: 25528 - protein, 15 aa, Homo sapiens
MKEEVPTALVEAHVR

SEQ ID NO: 25529 - protein, 15 aa, Homo sapiens
MKEEVPTALVEAHVR

SEQ ID NO: 25530 - protein, 10 aa, Homo sapiens
AKHLAAVEER

SEQ ID NO: 25531 - protein, 15 aa, Homo sapiens
MKEEVPTALVEAHVR

SEQ ID NO: 25532 - protein, 15 aa, Homo sapiens
MKEEVPTALVEAHVR

SEQ ID NO: 25533 - protein, 10 aa, Homo sapiens
AKHLAAVEER

SEQ ID NO: 25534 - protein, 15 aa, Homo sapiens
MKEEVPTALVEAHVR

SEQ ID NO: 25535 - protein, 23 aa, Homo sapiens
SALEEFSKMKEEVPTALVEAHVR

SEQ ID NO: 25536 - protein, 10 aa, Homo sapiens
AKHLAAVEER

SEQ ID NO: 25537 - protein, 10 aa, Homo sapiens
AKHLAAVEER

SEQ ID NO: 25538 - protein, 15 aa, Homo sapiens
MKEEVPTALVEAHVR

SEQ ID NO: 25539 - protein, 15 aa, Homo sapiens
MKEEVPTALVEAHVR

SEQ ID NO: 25540 - protein, 7 aa, Homo sapiens
KVEEAAK

SEQ ID NO: 25541 - protein, 7 aa, Homo sapiens
KVEEAAK

SEQ ID NO: 25542 - protein, 7 aa, Homo sapiens
KVEEAAK

SEQ ID NO: 25543 - protein, 15 aa, Homo sapiens
MKEEVPTALVEAHVR

SEQ ID NO: 25544 - protein, 15 aa, Homo sapiens
MKEEVPTALVEAHVR

SEQ ID NO: 25545 - protein, 15 aa, Homo sapiens
MKEEVPTALVEAHVR

SEQ ID NO: 25546 - protein, 7 aa, Homo sapiens
KVEEAAK

SEQ ID NO: 25547 - protein, 15 aa, Homo sapiens
MKEEVPTALVEAHVR

SEQ ID NO: 25548 - protein, 7 aa, Homo sapiens
KVEEAAK

SEQ ID NO: 25549 - protein, 15 aa, Homo sapiens
MKEEVPTALVEAHVR

SEQ ID NO: 25550 - protein, 7 aa, Homo sapiens
KVEEAAK

SEQ ID NO: 25551 - protein, 15 aa, Homo sapiens
MKEEVPTALVEAHVR

SEQ ID NO: 25552 - protein, 17 aa, Homo sapiens
EGQEEVLKEVVESEGER

SEQ ID NO: 25553 - protein, 18 aa, Homo sapiens
EGQEEVLKEVVESEGERK

SEQ ID NO: 25554 - protein, 20 aa, Homo sapiens
EPKEGQEEVLKEVVESEGER

SEQ ID NO: 25555 - protein, 20 aa, Homo sapiens
EPKEGQEEVLKEVVESEGER

SEQ ID NO: 25556 - protein, 20 aa, Homo sapiens
EPKEGQEEVLKEVVESEGER

SEQ ID NO: 25557 - protein, 20 aa, Homo sapiens
EPKEGQEEVLKEVVESEGER

SEQ ID NO: 25558 - protein, 20 aa, Homo sapiens
EPKEGQEEVLKEVVESEGER

SEQ ID NO: 25559 - protein, 13 aa, Homo sapiens
SDGDPIVDPEKEK

SEQ ID NO: 25560 - protein, 17 aa, Homo sapiens
ESEKSDGDPIVDPEKEK

SEQ ID NO: 25561 - protein, 17 aa, Homo sapiens
ESEKSDGDPIVDPEKEK

SEQ ID NO: 25562 - protein, 20 aa, Homo sapiens
EPKEGQEEVLKEVVESEGER

SEQ ID NO: 25563 - protein, 20 aa, Homo sapiens
EPKEGQEEVLKEVVESEGER

SEQ ID NO: 25564 - protein, 13 aa, Homo sapiens
SDGDPIVDPEKEK

SEQ ID NO: 25565 - protein, 20 aa, Homo sapiens
EPKEGQEEVLKEVVESEGER

SEQ ID NO: 25566 - protein, 13 aa, Homo sapiens
SDGDPIVDPEKEK

SEQ ID NO: 25567 - protein, 17 aa, Homo sapiens
ESEKSDGDPIVDPEKEK

SEQ ID NO: 25568 - protein, 13 aa, Homo sapiens
SDGDPIVDPEKEK

SEQ ID NO: 25569 - protein, 14 aa, Homo sapiens
TVNTKKDSESAPVK

SEQ ID NO: 25570 - protein, 14 aa, Homo sapiens
TVNTKKDSESAPVK

SEQ ID NO: 25571 - protein, 14 aa, Homo sapiens
TVNTKKDSESAPVK

SEQ ID NO: 25572 - protein, 30 aa, Homo sapiens; identical to SEQ ID NO: 8343

SEQ ID NO: 25573 - protein, 30 aa, Homo sapiens; identical to SEQ ID NO: 8343

SEQ ID NO: 25574 - protein, 8 aa, Homo sapiens
GKEGDSEK

SEQ ID NO: 25575 - protein, 8 aa, Homo sapiens
GKEGDSEK

SEQ ID NO: 25576 - protein, 8 aa, Homo sapiens
GKEGDSEK

SEQ ID NO: 25577 - protein, 8 aa, Homo sapiens
GKEGDSEK

SEQ ID NO: 25578 - protein, 5 aa, Homo sapiens
KDEEK

SEQ ID NO: 25579 - protein, 5 aa, Homo sapiens
KDEEK

SEQ ID NO: 25580 - protein, 7 aa, Homo sapiens
KDEEKGK

SEQ ID NO: 25581 - protein, 7 aa, Homo sapiens
KDEEKGK

SEQ ID NO: 25582 - protein, 7 aa, Homo sapiens
KDEEKGK

SEQ ID NO: 25583 - protein, 7 aa, Homo sapiens
KDEEKGK

SEQ ID NO: 25584 - protein, 7 aa, Homo sapiens
KDEEKGK

SEQ ID NO: 25585 - protein, 5 aa, Homo sapiens
KKNAK

SEQ ID NO: 25586 - protein, 23 aa, Homo sapiens
SALEEFSKMKEEVPTALVEAHVR

SEQ ID NO: 25587 - protein, 23 aa, Homo sapiens
SALEEFSKMKEEVPTALVEAHVR

SEQ ID NO: 25588 - protein, 23 aa, Homo sapiens
SALEEFSKMKEEVPTALVEAHVR

SEQ ID NO: 25589 - protein, 24 aa, Homo sapiens
KDPSAFFSFPVTDFIAPGYSMIIK

SEQ ID NO: 25590 - protein, 15 aa, Homo sapiens
LDLPPEKPLTSSLAK

SEQ ID NO: 25591 - protein, 5 aa, Homo sapiens
IEKER

SEQ ID NO: 25592 - protein, 5 aa, Homo sapiens
IEKER

SEQ ID NO: 25593 - protein, 5 aa, Homo sapiens
IEKER

SEQ ID NO: 25594 - protein, 7 aa, Homo sapiens
KPVDFKK

SEQ ID NO: 25595 - protein, 7 aa, Homo sapiens
IRNHKYR

SEQ ID NO: 25596 - protein, 5 aa, Homo sapiens
KIKER

SEQ ID NO: 25597 - protein, 10 aa, Homo sapiens
ASGKFELLDR

SEQ ID NO: 25598 - protein, 5 aa, Homo sapiens
KIKER

SEQ ID NO: 25599 - protein, 16 aa, Homo sapiens
VIQAGMFDQKSSSHER

SEQ ID NO: 25600 - protein, 8 aa, Homo sapiens
YKLNVDQK

SEQ ID NO: 25601 - protein, 8 aa, Homo sapiens
YKLNVDQK

SEQ ID NO: 25602 - protein, 16 aa, Homo sapiens
VIQAGMFDQKSSSHER

SEQ ID NO: 25603 - protein, 16 aa, Homo sapiens
VIQAGMFDQKSSSHER

SEQ ID NO: 25604 - protein, 16 aa, Homo sapiens
VIQAGMFDQKSSSHER

SEQ ID NO: 25605 - protein, 16 aa, Homo sapiens
VIQAGMFDQKSSSHER

SEQ ID NO: 25606 - protein, 7 aa, Homo sapiens
KPVDFKK

SEQ ID NO: 25607 - protein, 16 aa, Homo sapiens
GKGGAKTLMNTIMQLR

SEQ ID NO: 25608 - protein, 11 aa, Homo sapiens
AQILAYKMLAR

SEQ ID NO: 25609 - protein, 11 aa, Homo sapiens
AQILAYKMLAR

SEQ ID NO: 25610 - protein, 20 aa, Homo sapiens
LMEEDELPSWIIKDDAEVER

SEQ ID NO: 25611 - protein, 20 aa, Homo sapiens
LMEEDELPSWIIKDDAEVER

SEQ ID NO: 25612 - protein, 8 aa, Homo sapiens
YKLNVDQK

SEQ ID NO: 25613 - protein, 8 aa, Homo sapiens
YKLNVDQK

SEQ ID NO: 25614 - protein, 6 aa, Homo sapiens
EQKAKR

SEQ ID NO: 25615 - protein, 6 aa, Homo sapiens
EQKAKR

SEQ ID NO: 25616 - protein, 6 aa, Homo sapiens
EQKAKR

SEQ ID NO: 25617 - protein, 5 aa, Homo sapiens
EQKAK

SEQ ID NO: 25618 - protein, 6 aa, Homo sapiens
TKPNTK

SEQ ID NO: 25619 - protein, 9 aa, Homo sapiens
SKDKAATPR

SEQ ID NO: 25620 - protein, 9 aa, Homo sapiens
SKDKAATPR

SEQ ID NO: 25621 - protein, 9 aa, Homo sapiens
SKDKAATPR

SEQ ID NO: 25622 - protein, 5 aa, Homo sapiens
KDGPK

SEQ ID NO: 25623 - protein, 5 aa, Homo sapiens
KDGPK

SEQ ID NO: 25624 - protein, 5 aa, Homo sapiens
KDGPK

SEQ ID NO: 25625 - protein, 9 aa, Homo sapiens
SKDKAATPR

SEQ ID NO: 25626 - protein, 6 aa, Homo sapiens
KDGPKR

SEQ ID NO: 25627 - protein, 9 aa, Homo sapiens
SKDKAATPR

SEQ ID NO: 25628 - protein, 6 aa, Homo sapiens
KDGPKR

SEQ ID NO: 25629 - protein, 9 aa, Homo sapiens
SKDKAATPR

SEQ ID NO: 25630 - protein, 6 aa, Homo sapiens
KDGPKR

SEQ ID NO: 25631 - protein, 9 aa, Homo sapiens
SKDKAATPR

SEQ ID NO: 25632 - protein, 6 aa, Homo sapiens
KDGPKR

SEQ ID NO: 25633 - protein, 5 aa, Homo sapiens
KDGPK

SEQ ID NO: 25634 - protein, 6 aa, Homo sapiens
KDGPKR

SEQ ID NO: 25635 - protein, 6 aa, Homo sapiens
KDGPKR

SEQ ID NO: 25636 - protein, 9 aa, Homo sapiens
SKDKAATPR

SEQ ID NO: 25637 - protein, 6 aa, Homo sapiens
KDGPKR

SEQ ID NO: 25638 - protein, 6 aa, Homo sapiens
KDGPKR

SEQ ID NO: 25639 - protein, 6 aa, Homo sapiens
KDGPKR

SEQ ID NO: 25640 - protein, 6 aa, Homo sapiens
KDGPKR

SEQ ID NO: 25641 - protein, 5 aa, Homo sapiens
KAAKK

SEQ ID NO: 25642 - protein, 11 aa, Homo sapiens
VEASKVPEYIK

SEQ ID NO: 25643 - protein, 5 aa, Homo sapiens
KAAKK

SEQ ID NO: 25644 - protein, 10 aa, Homo sapiens
VPEYIKKAAK

SEQ ID NO: 25645 - protein, 14 aa, Homo sapiens
AAKKAAEFNSNLNR

SEQ ID NO: 25646 - protein, 14 aa, Homo sapiens
AAKKAAEFNSNLNR

SEQ ID NO: 25647 - protein, 10 aa, Homo sapiens
VPEYIKKAAK

SEQ ID NO: 25648 - protein, 11 aa, Homo sapiens
SVLSKSVPGYK

SEQ ID NO: 25649 - protein, 5 aa, Homo sapiens
KDGPK

SEQ ID NO: 25650 - protein, 6 aa, Homo sapiens
KDGPKR

SEQ ID NO: 25651 - protein, 23 aa, Homo sapiens
ITDHYKEYSQMQQQNTQKVEASK

SEQ ID NO: 25652 - protein, 23 aa, Homo sapiens
ITDHYKEYSQMQQQNTQKVEASK

SEQ ID NO: 25653 - protein, 15 aa, Homo sapiens
SDEVIDLMIKEYPAK

SEQ ID NO: 25654 - protein, 15 aa, Homo sapiens
SDEVIDLMIKEYPAK

SEQ ID NO: 25655 - protein, 8 aa, Homo sapiens
KYPDLERR

SEQ ID NO: 25656 - protein, 8 aa, Homo sapiens
KYPDLERR

SEQ ID NO: 25657 - protein, 8 aa, Homo sapiens
KYPDLERR

SEQ ID NO: 25658 - protein, 15 aa, Homo sapiens
SDEVIDLMIKEYPAK

SEQ ID NO: 25659 - protein, 15 aa, Homo sapiens
SDEVIDLMIKEYPAK

SEQ ID NO: 25660 - protein, 8 aa, Homo sapiens
KYPDLERR

SEQ ID NO: 25661 - protein, 8 aa, Homo sapiens
KYPDLERR

SEQ ID NO: 25662 - protein, 15 aa, Homo sapiens
SDEVIDLMIKEYPAK

SEQ ID NO: 25663 - protein, 15 aa, Homo sapiens
SDEVIDLMIKEYPAK

SEQ ID NO: 25664 - protein, 7 aa, Homo sapiens
KYPDLER

SEQ ID NO: 25665 - protein, 16 aa, Homo sapiens
EYPAKHAEYSVILQEK

SEQ ID NO: 25666 - protein, 8 aa, Homo sapiens
KYPDLERR

SEQ ID NO: 25667 - protein, 8 aa, Homo sapiens
KYPDLERR

SEQ ID NO: 25668 - protein, 18 aa, Homo sapiens
EYPAKHAEYSVILQEKER

SEQ ID NO: 25669 - protein, 8 aa, Homo sapiens
KYPDLERR

SEQ ID NO: 25670 - protein, 7 aa, Homo sapiens
KYPDLER

SEQ ID NO: 25671 - protein, 7 aa, Homo sapiens
KYPDLER

SEQ ID NO: 25672 - protein, 18 aa, Homo sapiens
EYPAKHAEYSVILQEKER

SEQ ID NO: 25673 - protein, 8 aa, Homo sapiens
KYPDLERR

SEQ ID NO: 25674 - protein, 8 aa, Homo sapiens
KYPDLERR

SEQ ID NO: 25675 - protein, 7 aa, Homo sapiens
KYPDLER

SEQ ID NO: 25676 - protein, 18 aa, Homo sapiens
EYPAKHAEYSVILQEKER

SEQ ID NO: 25677 - protein, 8 aa, Homo sapiens
RKYPDLER

SEQ ID NO: 25678 - protein, 7 aa, Homo sapiens
KYPDLER

SEQ ID NO: 25679 - protein, 8 aa, Homo sapiens
KYPDLERR

SEQ ID NO: 25680 - protein, 16 aa, Homo sapiens
EYPAKHAEYSVILQEK

SEQ ID NO: 25681 - protein, 7 aa, Homo sapiens
DLSHKEK

SEQ ID NO: 25682 - protein, 7 aa, Homo sapiens
DKAATPR

SEQ ID NO: 25683 - protein, 21 aa, Homo sapiens
TKVSSYPVALIPGQFQEYYKR

SEQ ID NO: 25684 - protein, 8 aa, Homo sapiens
YKVLPTER

SEQ ID NO: 25685 - protein, 8 aa, Homo sapiens
YKVLPTER

SEQ ID NO: 25686 - protein, 8 aa, Homo sapiens
YKVLPTER

SEQ ID NO: 25687 - protein, 6 aa, Homo sapiens
KDGPKR

SEQ ID NO: 25688 - protein, 13 aa, Homo sapiens
SVLSKSVPGYKPK

SEQ ID NO: 25689 - protein, 6 aa, Homo sapiens
HQEKKR

SEQ ID NO: 25690 - protein, 6 aa, Homo sapiens
HQEKKR

SEQ ID NO: 25691 - protein, 6 aa, Homo sapiens
HQEKKR

SEQ ID NO: 25692 - protein, 6 aa, Homo sapiens
HQEKKR

SEQ ID NO: 25693 - protein, 6 aa, Homo sapiens
HQEKKR

SEQ ID NO: 25694 - protein, 14 aa, Homo sapiens
FLESTDSFNNELKR

SEQ ID NO: 25695 - protein, 15 aa, Homo sapiens
KFLESTDSFNNELKR

SEQ ID NO: 25696 - protein, 15 aa, Homo sapiens
KFLESTDSFNNELKR

SEQ ID NO: 25697 - protein, 14 aa, Homo sapiens
FLESTDSFNNELKR

SEQ ID NO: 25698 - protein, 20 aa, Homo sapiens
VEVDMEKIAAEIAQAEEQAR

SEQ ID NO: 25699 - protein, 11 aa, Homo sapiens
PPDKPLMPYMR

SEQ ID NO: 25700 - protein, 11 aa, Homo sapiens
PPDKPLMPYMR

SEQ ID NO: 25701 - protein, 11 aa, Homo sapiens
PPDKPLMPYMR

SEQ ID NO: 25702 - protein, 11 aa, Homo sapiens
PPDKPLMPYMR

SEQ ID NO: 25703 - protein, 11 aa, Homo sapiens
PPDKPLMPYMR

SEQ ID NO: 25704 - protein, 11 aa, Homo sapiens
PPDKPLMPYMR

SEQ ID NO: 25705 - protein, 11 aa, Homo sapiens
PPDKPLMPYMR

SEQ ID NO: 25706 - protein, 11 aa, Homo sapiens
PPDKPLMPYMR

SEQ ID NO: 25707 - protein, 11 aa, Homo sapiens
PPDKPLMPYMR

SEQ ID NO: 25708 - protein, 11 aa, Homo sapiens
PPDKPLMPYMR

SEQ ID NO: 25709 - protein, 11 aa, Homo sapiens
PPDKPLMPYMR

SEQ ID NO: 25710 - protein, 15 aa, Homo sapiens
KIKSLVALLVETQMK

SEQ ID NO: 25711 - protein, 15 aa, Homo sapiens
KIKSLVALLVETQMK

SEQ ID NO: 25712 - protein, 15 aa, Homo sapiens
VASAAAKAALEEFSR

SEQ ID NO: 25713 - protein, 15 aa, Homo sapiens
VASAAAKAALEEFSR

SEQ ID NO: 25714 - protein, 15 aa, Homo sapiens
VASAAAKAALEEFSR

SEQ ID NO: 25715 - protein, 16 aa, Homo sapiens
VREEVPLELVEAHVKK

SEQ ID NO: 25716 - protein, 15 aa, Homo sapiens
VASAAAKAALEEFSR

SEQ ID NO: 25717 - protein, 15 aa, Homo sapiens
VASAAAKAALEEFSR

SEQ ID NO: 25718 - protein, 7 aa, Homo sapiens
KVQEAAR

SEQ ID NO: 25719 - protein, 7 aa, Homo sapiens
KVQEAAR

SEQ ID NO: 25720 - protein, 7 aa, Homo sapiens
KVQEAAR

SEQ ID NO: 25721 - protein, 14 aa, Homo sapiens
ISTKNEEPVRSPER

SEQ ID NO: 25722 - protein, 7 aa, Homo sapiens
KASANAR

SEQ ID NO: 25723 - protein, 7 aa, Homo sapiens
KASANAR

SEQ ID NO: 25724 - protein, 7 aa, Homo sapiens
KASANAR

SEQ ID NO: 25725 - protein, 14 aa, Homo sapiens
ISTKNEEPVRSPER

SEQ ID NO: 25726 - protein, 11 aa, Homo sapiens
TDIYSKKTLAK

SEQ ID NO: 25727 - protein, 5 aa, Homo sapiens
KKSGK

SEQ ID NO: 25728 - protein, 10 aa, Homo sapiens
KGQASLYGKR

SEQ ID NO: 25729 - protein, 5 aa, Homo sapiens
KKSGK

SEQ ID NO: 25730 - protein, 9 aa, Homo sapiens
KGQASLYGK

SEQ ID NO: 25731 - protein, 5 aa, Homo sapiens
KKSGK

SEQ ID NO: 25732 - protein, 5 aa, Homo sapiens
KKSGK

SEQ ID NO: 25733 - protein, 5 aa, Homo sapiens
KKSGK

SEQ ID NO: 25734 - protein, 18 aa, Homo sapiens
SPQVPAAQQMLNFPEKNK

SEQ ID NO: 25735 - protein, 18 aa, Homo sapiens
SPQVPAAQQMLNFPEKNK

SEQ ID NO: 25736 - protein, 18 aa, Homo sapiens
SPQVPAAQQMLNFPEKNK

SEQ ID NO: 25737 - protein, 12 aa, Homo sapiens
EKPVDLQNFGLR

SEQ ID NO: 25738 - protein, 18 aa, Homo sapiens
SPQVPAAQQMLNFPEKNK

SEQ ID NO: 25739 - protein, 18 aa, Homo sapiens
SPQVPAAQQMLNFPEKNK

SEQ ID NO: 25740 - protein, 12 aa, Homo sapiens
EKPVDLQNFGLR

SEQ ID NO: 25741 - protein, 12 aa, Homo sapiens
EKPVDLQNFGLR

SEQ ID NO: 25742 - protein, 18 aa, Homo sapiens
SPQVPAAQQMLNFPEKNK

SEQ ID NO: 25743 - protein, 12 aa, Homo sapiens
EKPVDLQNFGLR

SEQ ID NO: 25744 - protein, 12 aa, Homo sapiens
EKPVDLQNFGLR

SEQ ID NO: 25745 - protein, 9 aa, Homo sapiens
KGQASLYGK

SEQ ID NO: 25746 - protein, 10 aa, Homo sapiens
KGQASLYGKR

SEQ ID NO: 25747 - protein, 5 aa, Homo sapiens
KKSGK

SEQ ID NO: 25748 - protein, 4 aa, Homo sapiens
KSGK

SEQ ID NO: 25749 - protein, 5 aa, Homo sapiens
KKSGK

SEQ ID NO: 25750 - protein, 11 aa, Homo sapiens
SKTPEIYLAYR

SEQ ID NO: 25751 - protein, 11 aa, Homo sapiens
ALPEFFNGKNK

SEQ ID NO: 25752 - protein, 5 aa, Homo sapiens
KTLAK

SEQ ID NO: 25753 - protein, 7 aa, Homo sapiens
KVQEAAR

SEQ ID NO: 25754 - protein, 7 aa, Homo sapiens
KVQEAAR

SEQ ID NO: 25755 - protein, 7 aa, Homo sapiens
KVQEAAR

SEQ ID NO: 25756 - protein, 7 aa, Homo sapiens
KVQEAAR

SEQ ID NO: 25757 - protein, 7 aa, Homo sapiens
KVQEAAR

SEQ ID NO: 25758 - protein, 7 aa, Homo sapiens
KVQEAAR

SEQ ID NO: 25759 - protein, 12 aa, Homo sapiens
TLAKSKGASAGR

SEQ ID NO: 25760 - protein, 6 aa, Homo sapiens
TLAKSK

SEQ ID NO: 25761 - protein, 6 aa, Homo sapiens
TLAKSK

SEQ ID NO: 25762 - protein, 11 aa, Homo sapiens
TDIYSKKTLAK

SEQ ID NO: 25763 - protein, 8 aa, Homo sapiens
SKGASAGR

SEQ ID NO: 25764 - protein, 7 aa, Homo sapiens
TDIYSKK

SEQ ID NO: 25765 - protein, 7 aa, Homo sapiens
TDIYSKK

SEQ ID NO: 25766 - protein, 22 aa, Homo sapiens
KDLYANTVLSGGTTMYPGIADR

SEQ ID NO: 25767 - protein, 22 aa, Homo sapiens
KDLYANTVLSGGTTMYPGIADR

SEQ ID NO: 25768 - protein, 22 aa, Homo sapiens
KDLYANTVLSGGTTMYPGIADR

SEQ ID NO: 25769 - protein, 22 aa, Homo sapiens
KDLYANTVLSGGTTMYPGIADR

SEQ ID NO: 25770 - protein, 22 aa, Homo sapiens
KDLYANTVLSGGTTMYPGIADR

SEQ ID NO: 25771 - protein, 22 aa, Homo sapiens
KDLYANTVLSGGTTMYPGIADR

SEQ ID NO: 25772 - protein, 13 aa, Homo sapiens
EITALAPSTMKIK

SEQ ID NO: 25773 - protein, 13 aa, Homo sapiens
EITALAPSTMKIK

SEQ ID NO: 25774 - protein, 22 aa, Homo sapiens
KDLYANTVLSGGTTMYPGIADR

SEQ ID NO: 25775 - protein, 22 aa, Homo sapiens
KDLYANTVLSGGTTMYPGIADR

SEQ ID NO: 25776 - protein, 22 aa, Homo sapiens
KDLYANTVLSGGTTMYPGIADR

SEQ ID NO: 25777 - protein, 22 aa, Homo sapiens
KDLYANTVLSGGTTMYPGIADR

SEQ ID NO: 25778 - protein, 22 aa, Homo sapiens
KDLYANTVLSGGTTMYPGIADR

SEQ ID NO: 25779 - protein, 22 aa, Homo sapiens
KDLYANTVLSGGTTMYPGIADR

SEQ ID NO: 25780 - protein, 22 aa, Homo sapiens
KDLYANTVLSGGTTMYPGIADR

SEQ ID NO: 25781 - protein, 22 aa, Homo sapiens
KDLYANTVLSGGTTMYPGIADR

SEQ ID NO: 25782 - protein, 22 aa, Homo sapiens
KDLYANTVLSGGTTMYPGIADR

SEQ ID NO: 25783 - protein, 22 aa, Homo sapiens
KDLYANTVLSGGTTMYPGIADR

SEQ ID NO: 25784 - protein, 22 aa, Homo sapiens
KDLYANTVLSGGTTMYPGIADR

SEQ ID NO: 25785 - protein, 22 aa, Homo sapiens
KDLYANTVLSGGTTMYPGIADR

SEQ ID NO: 25786 - protein, 22 aa, Homo sapiens
KDLYANTVLSGGTTMYPGIADR

SEQ ID NO: 25787 - protein, 22 aa, Homo sapiens
KDLYANTVLSGGTTMYPGIADR

SEQ ID NO: 25788 - protein, 22 aa, Homo sapiens
KDLYANTVLSGGTTMYPGIADR

SEQ ID NO: 25789 - protein, 22 aa, Homo sapiens
KDLYANTVLSGGTTMYPGIADR

SEQ ID NO: 25790 - protein, 22 aa, Homo sapiens
KDLYANTVLSGGTTMYPGIADR

SEQ ID NO: 25791 - protein, 22 aa, Homo sapiens
KDLYANTVLSGGTTMYPGIADR

SEQ ID NO: 25792 - protein, 21 aa, Homo sapiens
VAPEEHPVLLTEAPLNPKANR

SEQ ID NO: 25793 - protein, 21 aa, Homo sapiens
VAPEEHPVLLTEAPLNPKANR

SEQ ID NO: 25794 - protein, 21 aa, Homo sapiens
VAPEEHPVLLTEAPLNPKANR

SEQ ID NO: 25795 - protein, 21 aa, Homo sapiens
VAPEEHPVLLTEAPLNPKANR

SEQ ID NO: 25796 - protein, 21 aa, Homo sapiens
VAPEEHPVLLTEAPLNPKANR

SEQ ID NO: 25797 - protein, 21 aa, Homo sapiens
VAPEEHPVLLTEAPLNPKANR

SEQ ID NO: 25798 - protein, 12 aa, Homo sapiens
DSYVGDEAQSKR

SEQ ID NO: 25799 - protein, 14 aa, Homo sapiens
MQKEITALAPSTMK

SEQ ID NO: 25800 - protein, 20 aa, Homo sapiens
EITALAPSTMKIKIIAPPER

SEQ ID NO: 25801 - protein, 23 aa, Homo sapiens
LISELFQKLPSKVQYPDYYAIIK

SEQ ID NO: 25802 - protein, 13 aa, Homo sapiens
NLETAKKAEYEER

SEQ ID NO: 25803 - protein, 10 aa, Homo sapiens
AAKVAEQQER

SEQ ID NO: 25804 - protein, 10 aa, Homo sapiens
AAKVAEQQER

SEQ ID NO: 25805 - protein, 10 aa, Homo sapiens
AAKVAEQQER

SEQ ID NO: 25806 - protein, 7 aa, Homo sapiens
NLETAKK

SEQ ID NO: 25807 - protein, 10 aa, Homo sapiens
AAKVAEQQER

SEQ ID NO: 25808 - protein, 7 aa, Homo sapiens
NLETAKK

SEQ ID NO: 25809 - protein, 7 aa, Homo sapiens
NLETAKK

SEQ ID NO: 25810 - protein, 10 aa, Homo sapiens
KYPDYYQQIK

SEQ ID NO: 25811 - protein, 19 aa, Homo sapiens
KYPDYYQQIKMPISLQQIR

SEQ ID NO: 25812 - protein, 19 aa, Homo sapiens
KYPDYYQQIKMPISLQQIR

SEQ ID NO: 25813 - protein, 17 aa, Homo sapiens
AVIKAQHPDYSFGELSR

SEQ ID NO: 25814 - protein, 17 aa, Homo sapiens
AVIKAQHPDYSFGELSR

SEQ ID NO: 25815 - protein, 17 aa, Homo sapiens
AVIKAQHPDYSFGELSR

SEQ ID NO: 25816 - protein, 17 aa, Homo sapiens
AVIKAQHPDYSFGELSR

SEQ ID NO: 25817 - protein, 6 aa, Homo sapiens
KEKLPK

SEQ ID NO: 25818 - protein, 6 aa, Homo sapiens
KEKLPK

SEQ ID NO: 25819 - protein, 6 aa, Homo sapiens
KEKLPK

SEQ ID NO: 25820 - protein, 6 aa, Homo sapiens
KEKLPK

SEQ ID NO: 25821 - protein, 6 aa, Homo sapiens
KEKLPK

SEQ ID NO: 25822 - protein, 6 aa, Homo sapiens
KEKLPK

SEQ ID NO: 25823 - protein, 6 aa, Homo sapiens
KEKLPK

SEQ ID NO: 25824 - protein, 5 aa, Homo sapiens
LKLSR

SEQ ID NO: 25825 - protein, 11 aa, Homo sapiens
KSKYMTPMQQK

SEQ ID NO: 25826 - protein, 11 aa, Homo sapiens
KSKYMTPMQQK

SEQ ID NO: 25827 - protein, 5 aa, Homo sapiens
LLKEK

SEQ ID NO: 25828 - protein, 5 aa, Homo sapiens
LLKEK

SEQ ID NO: 25829 - protein, 16 aa, Homo sapiens
KELGPLPDDDDMASPK

SEQ ID NO: 25830 - protein, 5 aa, Homo sapiens
LLKEK

SEQ ID NO: 25831 - protein, 11 aa, Homo sapiens
KSKYMTPMQQK

SEQ ID NO: 25832 - protein, 10 aa, Homo sapiens
SKYMTPMQQK

SEQ ID NO: 25833 - protein, 11 aa, Homo sapiens
KSKYMTPMQQK

SEQ ID NO: 25834 - protein, 12 aa, Homo sapiens
VLKLQQVMQAKK

SEQ ID NO: 25835 - protein, 9 aa, Homo sapiens
LQQVMQAKK

SEQ ID NO: 25836 - protein, 9 aa, Homo sapiens
LQQVMQAKK

SEQ ID NO: 25837 - protein, 6 aa, Homo sapiens
KKELAR

SEQ ID NO: 25838 - protein, 5 aa, Homo sapiens
KELAR

SEQ ID NO: 25839 - protein, 5 aa, Homo sapiens
KELAR

SEQ ID NO: 25840 - protein, 7 aa, Homo sapiens
KSGISPK

SEQ ID NO: 25841 - protein, 5 aa, Homo sapiens
LKLSR

SEQ ID NO: 25842 - protein, 15 aa, Homo sapiens
KPIVPQKEPSPLLEK

SEQ ID NO: 25843 - protein, 8 aa, Homo sapiens
KIQLLEAK

SEQ ID NO: 25844 - protein, 8 aa, Homo sapiens
KIQLLEAK

SEQ ID NO: 25845 - protein, 5 aa, Homo sapiens
APKRR

SEQ ID NO: 25846 - protein, 5 aa, Homo sapiens
APKRR

SEQ ID NO: 25847 - protein, 5 aa, Homo sapiens
TKSFK

SEQ ID NO: 25848 - protein, 5 aa, Homo sapiens
TKSFK

SEQ ID NO: 25849 - protein, 11 aa, Homo sapiens
VLKLQQVMQAK

SEQ ID NO: 25850 - protein, 11 aa, Homo sapiens
YNVPNSAIYKR

SEQ ID NO: 25851 - protein, 12 aa, Homo sapiens
RYNVPNSAIYKR

SEQ ID NO: 25852 - protein, 12 aa, Homo sapiens
RYNVPNSAIYKR

SEQ ID NO: 25853 - protein, 12 aa, Homo sapiens
VLKLQQVMQAKK

SEQ ID NO: 25854 - protein, 11 aa, Homo sapiens
VLKLQQVMQAK

SEQ ID NO: 25855 - protein, 11 aa, Homo sapiens
YNVPNSAIYKR

SEQ ID NO: 25856 - protein, 12 aa, Homo sapiens
RYNVPNSAIYKR

SEQ ID NO: 25857 - protein, 12 aa, Homo sapiens
RYNVPNSAIYKR

SEQ ID NO: 25858 - protein, 11 aa, Homo sapiens
VLKLQQVMQAK

SEQ ID NO: 25859 - protein, 11 aa, Homo sapiens
VLKLQQVMQAK

SEQ ID NO: 25860 - protein, 11 aa, Homo sapiens
YNVPNSAIYKR

SEQ ID NO: 25861 - protein, 11 aa, Homo sapiens
VLKLQQVMQAK

SEQ ID NO: 25862 - protein, 12 aa, Homo sapiens
RYNVPNSAIYKR

SEQ ID NO: 25863 - protein, 11 aa, Homo sapiens
VLKLQQVMQAK

SEQ ID NO: 25864 - protein, 12 aa, Homo sapiens
VLKLQQVMQAKK

SEQ ID NO: 25865 - protein, 11 aa, Homo sapiens
VLKLQQVMQAK

SEQ ID NO: 25866 - protein, 12 aa, Homo sapiens
VLKLQQVMQAKK

SEQ ID NO: 25867 - protein, 11 aa, Homo sapiens
VLKLQQVMQAK

SEQ ID NO: 25868 - protein, 11 aa, Homo sapiens
YNVPNSAIYKR

SEQ ID NO: 25869 - protein, 11 aa, Homo sapiens
YNVPNSAIYKR

SEQ ID NO: 25870 - protein, 12 aa, Homo sapiens
RYNVPNSAIYKR

SEQ ID NO: 25871 - protein, 11 aa, Homo sapiens
VLKLQQVMQAK

SEQ ID NO: 25872 - protein, 11 aa, Homo sapiens
YNVPNSAIYKR

SEQ ID NO: 25873 - protein, 12 aa, Homo sapiens
VLKLQQVMQAKK

SEQ ID NO: 25874 - protein, 12 aa, Homo sapiens
VLKLQQVMQAKK

SEQ ID NO: 25875 - protein, 12 aa, Homo sapiens
RYNVPNSAIYKR

SEQ ID NO: 25876 - protein, 11 aa, Homo sapiens
VLKLQQVMQAK

SEQ ID NO: 25877 - protein, 11 aa, Homo sapiens
VLKLQQVMQAK

SEQ ID NO: 25878 - protein, 11 aa, Homo sapiens
VLKLQQVMQAK

SEQ ID NO: 25879 - protein, 11 aa, Homo sapiens
YNVPNSAIYKR

SEQ ID NO: 25880 - protein, 11 aa, Homo sapiens
YNVPNSAIYKR

SEQ ID NO: 25881 - protein, 11 aa, Homo sapiens
YNVPNSAIYKR

SEQ ID NO: 25882 - protein, 11 aa, Homo sapiens
YNVPNSAIYKR

SEQ ID NO: 25883 - protein, 11 aa, Homo sapiens
YNVPNSAIYKR

SEQ ID NO: 25884 - protein, 11 aa, Homo sapiens
YNVPNSAIYKR

SEQ ID NO: 25885 - protein, 11 aa, Homo sapiens
YNVPNSAIYKR

SEQ ID NO: 25886 - protein, 11 aa, Homo sapiens
YNVPNSAIYKR

SEQ ID NO: 25887 - protein, 11 aa, Homo sapiens
VLKLQQVMQAK

SEQ ID NO: 25888 - protein, 11 aa, Homo sapiens
VLKLQQVMQAK

SEQ ID NO: 25889 - protein, 19 aa, Homo sapiens
EAEKSEDSSGAAGLSGLHR

SEQ ID NO: 25890 - protein, 6 aa, Homo sapiens
YSAKTK

SEQ ID NO: 25891 - protein, 6 aa, Homo sapiens
YSAKTK

SEQ ID NO: 25892 - protein, 11 aa, Homo sapiens
HLHNDVEKERK

SEQ ID NO: 25893 - protein, 6 aa, Homo sapiens
KEKLPK

SEQ ID NO: 25894 - protein, 10 aa, Homo sapiens
YNESDKQMKK

SEQ ID NO: 25895 - protein, 10 aa, Homo sapiens
YNESDKQMKK

SEQ ID NO: 25896 - protein, 6 aa, Homo sapiens
FKGLKR

SEQ ID NO: 25897 - protein, 5 aa, Homo sapiens
FKGLK

SEQ ID NO: 25898 - protein, 6 aa, Homo sapiens
FKGLKR

SEQ ID NO: 25899 - protein, 10 aa, Homo sapiens
YNESDKQMKK

SEQ ID NO: 25900 - protein, 10 aa, Homo sapiens
YNESDKQMKK

SEQ ID NO: 25901 - protein, 6 aa, Homo sapiens
FKGLKR

SEQ ID NO: 25902 - protein, 10 aa, Homo sapiens
YNESDKQMKK

SEQ ID NO: 25903 - protein, 10 aa, Homo sapiens
YNESDKQMKK

SEQ ID NO: 25904 - protein, 10 aa, Homo sapiens
YNESDKQMKK

SEQ ID NO: 25905 - protein, 10 aa, Homo sapiens
YNESDKQMKK

SEQ ID NO: 25906 - protein, 10 aa, Homo sapiens
YNESDKQMKK

SEQ ID NO: 25907 - protein, 10 aa, Homo sapiens
YNESDKQMKK

SEQ ID NO: 25908 - protein, 6 aa, Homo sapiens
FKGLKR

SEQ ID NO: 25909 - protein, 6 aa, Homo sapiens
FKGLKR

SEQ ID NO: 25910 - protein, 10 aa, Homo sapiens
YNESDKQMKK

SEQ ID NO: 25911 - protein, 6 aa, Homo sapiens
FKGLKR

SEQ ID NO: 25912 - protein, 6 aa, Homo sapiens
FKGLKR

SEQ ID NO: 25913 - protein, 5 aa, Homo sapiens
FKGLK

SEQ ID NO: 25914 - protein, 6 aa, Homo sapiens
FKGLKR

SEQ ID NO: 25915 - protein, 6 aa, Homo sapiens
FKGLKR

SEQ ID NO: 25916 - protein, 6 aa, Homo sapiens
FKGLKR

SEQ ID NO: 25917 - protein, 6 aa, Homo sapiens
KKELAR

SEQ ID NO: 25918 - protein, 6 aa, Homo sapiens
KKELAR

SEQ ID NO: 25919 - protein, 8 aa, Homo sapiens
NPTSKYYR

SEQ ID NO: 25920 - protein, 6 aa, Homo sapiens
KKELAR

SEQ ID NO: 25921 - protein, 12 aa, Homo sapiens
LISELFQKLPSK

SEQ ID NO: 25922 - protein, 12 aa, Homo sapiens
LISELFQKLPSK

SEQ ID NO: 25923 - protein, 12 aa, Homo sapiens
LISELFQKLPSK

SEQ ID NO: 25924 - protein, 12 aa, Homo sapiens
LISELFQKLPSK

SEQ ID NO: 25925 - protein, 12 aa, Homo sapiens
LISELFQKLPSK

SEQ ID NO: 25926 - protein, 12 aa, Homo sapiens
LISELFQKLPSK

SEQ ID NO: 25927 - protein, 12 aa, Homo sapiens
LISELFQKLPSK

SEQ ID NO: 25928 - protein, 12 aa, Homo sapiens
LISELFQKLPSK

SEQ ID NO: 25929 - protein, 12 aa, Homo sapiens
LISELFQKLPSK

SEQ ID NO: 25930 - protein, 12 aa, Homo sapiens
LISELFQKLPSK

SEQ ID NO: 25931 - protein, 11 aa, Homo sapiens
EPIDLKTIAQR

SEQ ID NO: 25932 - protein, 12 aa, Homo sapiens
LISELFQKLPSK

SEQ ID NO: 25933 - protein, 22 aa, Homo sapiens
VQYPDYYAIIKEPIDLKTIAQR

SEQ ID NO: 25934 - protein, 12 aa, Homo sapiens
LISELFQKLPSK

SEQ ID NO: 25935 - protein, 12 aa, Homo sapiens
LISELFQKLPSK

SEQ ID NO: 25936 - protein, 22 aa, Homo sapiens
VQYPDYYAIIKEPIDLKTIAQR

SEQ ID NO: 25937 - protein, 11 aa, Homo sapiens
VLKLQQVMQAK

SEQ ID NO: 25938 - protein, 6 aa, Homo sapiens
KKELAR

SEQ ID NO: 25939 - protein, 6 aa, Homo sapiens
LLKEKR

SEQ ID NO: 25940 - protein, 5 aa, Homo sapiens
LKLSR

SEQ ID NO: 25941 - protein, 19 aa, Homo sapiens
EAEKSEDSSGAAGLSGLHR

SEQ ID NO: 25942 - protein, 15 aa, Homo sapiens
EVFKSDYYNKVPVSK

SEQ ID NO: 25943 - protein, 15 aa, Homo sapiens
EVFKSDYYNKVPVSK

SEQ ID NO: 25944 - protein, 15 aa, Homo sapiens
EVFKSDYYNKVPVSK

SEQ ID NO: 25945 - protein, 14 aa, Homo sapiens
AEIEHHEMAKSSLR

SEQ ID NO: 25946 - protein, 9 aa, Homo sapiens
YNESDKQMK

SEQ ID NO: 25947 - protein, 10 aa, Homo sapiens
YNESDKQMKK

SEQ ID NO: 25948 - protein, 10 aa, Homo sapiens
YNESDKQMKK

SEQ ID NO: 25949 - protein, 9 aa, Homo sapiens
YNESDKQMK

SEQ ID NO: 25950 - protein, 9 aa, Homo sapiens
YNESDKQMK

SEQ ID NO: 25951 - protein, 9 aa, Homo sapiens
YNESDKQMK

SEQ ID NO: 25952 - protein, 23 aa, Homo sapiens
RDDIEDGDSMISSATSDTGSAKR

SEQ ID NO: 25953 - protein, 7 aa, Homo sapiens
KSGISPK

SEQ ID NO: 25954 - protein, 15 aa, Homo sapiens
LNEVYEAVKNYTDKR

SEQ ID NO: 25955 - protein, 15 aa, Homo sapiens
LNEVYEAVKNYTDKR

SEQ ID NO: 25956 - protein, 7 aa, Homo sapiens
KAEYEER

SEQ ID NO: 25957 - protein, 7 aa, Homo sapiens
KAEYEER

SEQ ID NO: 25958 - protein, 12 aa, Homo sapiens
AAKVAEQQERER

SEQ ID NO: 25959 - protein, 7 aa, Homo sapiens
KAEYEER

SEQ ID NO: 25960 - protein, 7 aa, Homo sapiens
KAEYEER

SEQ ID NO: 25961 - protein, 17 aa, Homo sapiens
AVIKAQHPDYSFGELSR

SEQ ID NO: 25962 - protein, 6 aa, Homo sapiens
KEGSKR

SEQ ID NO: 25963 - protein, 19 aa, Homo sapiens
EAEKSEDSSGAAGLSGLHR

SEQ ID NO: 25964 - protein, 6 aa, Homo sapiens
REEEKR

SEQ ID NO: 25965 - protein, 6 aa, Homo sapiens
REEEKR

SEQ ID NO: 25966 - protein, 6 aa, Homo sapiens
REEEKR

SEQ ID NO: 25967 - protein, 6 aa, Homo sapiens
REEEKR

SEQ ID NO: 25968 - protein, 5 aa, Homo sapiens
EEEKR

SEQ ID NO: 25969 - protein, 5 aa, Homo sapiens
EEEKR

SEQ ID NO: 25970 - protein, 6 aa, Homo sapiens
REEEKR

SEQ ID NO: 25971 - protein, 5 aa, Homo sapiens
LKLSR

SEQ ID NO: 25972 - protein, 5 aa, Homo sapiens
LKLSR

SEQ ID NO: 25973 - protein, 4 aa, Homo sapiens
KNIR

SEQ ID NO: 25974 - protein, 14 aa, Homo sapiens
SKGAHTTMADALWR

SEQ ID NO: 25975 - protein, 14 aa, Homo sapiens
SKGAHTTMADALWR

SEQ ID NO: 25976 - protein, 9 aa, Homo sapiens
LPSHWLKSK

SEQ ID NO: 25977 - protein, 5 aa, Homo sapiens
KELAR

SEQ ID NO: 25978 - protein, 15 aa, Homo sapiens
LTGPSHSKGSLGEER

SEQ ID NO: 25979 - protein, 8 aa, Homo sapiens
NPTSKYYR

SEQ ID NO: 25980 - protein, 15 aa, Homo sapiens
LTGPSHSKGSLGEER

SEQ ID NO: 25981 - protein, 15 aa, Homo sapiens
LTGPSHSKGSLGEER

SEQ ID NO: 25982 - protein, 8 aa, Homo sapiens
NPTSKYYR

SEQ ID NO: 25983 - protein, 8 aa, Homo sapiens
NPTSKYYR

SEQ ID NO: 25984 - protein, 8 aa, Homo sapiens
NPTSKYYR

SEQ ID NO: 25985 - protein, 15 aa, Homo sapiens
LTGPSHSKGSLGEER

SEQ ID NO: 25986 - protein, 8 aa, Homo sapiens
NPTSKYYR

SEQ ID NO: 25987 - protein, 15 aa, Homo sapiens
LTGPSHSKGSLGEER

SEQ ID NO: 25988 - protein, 15 aa, Homo sapiens
LTGPSHSKGSLGEER

SEQ ID NO: 25989 - protein, 15 aa, Homo sapiens
LTGPSHSKGSLGEER

SEQ ID NO: 25990 - protein, 15 aa, Homo sapiens
LTGPSHSKGSLGEER

SEQ ID NO: 25991 - protein, 15 aa, Homo sapiens
LTGPSHSKGSLGEER

SEQ ID NO: 25992 - protein, 11 aa, Homo sapiens
VLKLQQVMQAK

SEQ ID NO: 25993 - protein, 15 aa, Homo sapiens
LTGPSHSKGSLGEER

SEQ ID NO: 25994 - protein, 5 aa, Homo sapiens
LKLSR

SEQ ID NO: 25995 - protein, 6 aa, Homo sapiens
KKELAR

SEQ ID NO: 25996 - protein, 11 aa, Homo sapiens
VLKLQQVMQAK

SEQ ID NO: 25997 - protein, 11 aa, Homo sapiens
VLKLQQVMQAK

SEQ ID NO: 25998 - protein, 23 aa, Homo sapiens
RDDIEDGDSMISSATSDTGSAKR

SEQ ID NO: 25999 - protein, 23 aa, Homo sapiens
RDDIEDGDSMISSATSDTGSAKR

SEQ ID NO: 26000 - protein, 23 aa, Homo sapiens
RDDIEDGDSMISSATSDTGSAKR

SEQ ID NO: 26001 - protein, 23 aa, Homo sapiens
RDDIEDGDSMISSATSDTGSAKR

SEQ ID NO: 26002 - protein, 23 aa, Homo sapiens
RDDIEDGDSMISSATSDTGSAKR

SEQ ID NO: 26003 - protein, 12 aa, Homo sapiens
VLKLQQVMQAKK

SEQ ID NO: 26004 - protein, 12 aa, Homo sapiens
VLKLQQVMQAKK

SEQ ID NO: 26005 - protein, 6 aa, Homo sapiens
KKELAR

SEQ ID NO: 26006 - protein, 11 aa, Homo sapiens
VLKLQQVMQAK

SEQ ID NO: 26007 - protein, 11 aa, Homo sapiens
VLKLQQVMQAK

SEQ ID NO: 26008 - protein, 6 aa, Homo sapiens
KKELAR

SEQ ID NO: 26009 - protein, 6 aa, Homo sapiens
KKELAR

SEQ ID NO: 26010 - protein, 17 aa, Homo sapiens
AVIKAQHPDYSFGELSR

SEQ ID NO: 26011 - protein, 17 aa, Homo sapiens
AVIKAQHPDYSFGELSR

SEQ ID NO: 26012 - protein, 17 aa, Homo sapiens
AVIKAQHPDYSFGELSR

SEQ ID NO: 26013 - protein, 17 aa, Homo sapiens
AVIKAQHPDYSFGELSR

SEQ ID NO: 26014 - protein, 11 aa, Homo sapiens
DVHLSKEQESR

SEQ ID NO: 26015 - protein, 17 aa, Homo sapiens
AVIKAQHPDYSFGELSR

SEQ ID NO: 26016 - protein, 7 aa, Homo sapiens
NLETAKK

SEQ ID NO: 26017 - protein, 10 aa, Homo sapiens
AAKVAEQQER

SEQ ID NO: 26018 - protein, 10 aa, Homo sapiens
AAKVAEQQER

SEQ ID NO: 26019 - protein, 10 aa, Homo sapiens
AAKVAEQQER

SEQ ID NO: 26020 - protein, 7 aa, Homo sapiens
KAEYEER

SEQ ID NO: 26021 - protein, 7 aa, Homo sapiens
KAEYEER

SEQ ID NO: 26022 - protein, 16 aa, Homo sapiens
DYPDYYKIILEPMDLK

SEQ ID NO: 26023 - protein, 17 aa, Homo sapiens
KDYPDYYKIILEPMDLK

SEQ ID NO: 26024 - protein, 11 aa, Homo sapiens
LCDLFMVKPSK

SEQ ID NO: 26025 - protein, 11 aa, Homo sapiens
LCDLFMVKPSK

SEQ ID NO: 26026 - protein, 8 aa, Homo sapiens
KDYPDYYK

SEQ ID NO: 26027 - protein, 8 aa, Homo sapiens
KDYPDYYK

SEQ ID NO: 26028 - protein, 11 aa, Homo sapiens
LCDLFMVKPSK

SEQ ID NO: 26029 - protein, 11 aa, Homo sapiens
LCDLFMVKPSK

SEQ ID NO: 26030 - protein, 11 aa, Homo sapiens
LCDLFMVKPSK

SEQ ID NO: 26031 - protein, 8 aa, Homo sapiens
KDYPDYYK

SEQ ID NO: 26032 - protein, 12 aa, Homo sapiens
RLCDLFMVKPSK

SEQ ID NO: 26033 - protein, 11 aa, Homo sapiens
LCDLFMVKPSK

SEQ ID NO: 26034 - protein, 8 aa, Homo sapiens
KDYPDYYK

SEQ ID NO: 26035 - protein, 8 aa, Homo sapiens
KDYPDYYK

SEQ ID NO: 26036 - protein, 12 aa, Homo sapiens
RLCDLFMVKPSK

SEQ ID NO: 26037 - protein, 15 aa, Homo sapiens
KPIVPQKEPSPLLEK

SEQ ID NO: 26038 - protein, 15 aa, Homo sapiens
KPIVPQKEPSPLLEK

SEQ ID NO: 26039 - protein, 13 aa, Homo sapiens
LTCEEEEEKMFGR

SEQ ID NO: 26040 - protein, 10 aa, Homo sapiens
LDGTTKAEDR

SEQ ID NO: 26041 - protein, 8 aa, Homo sapiens
YKLNVDQK

SEQ ID NO: 26042 - protein, 8 aa, Homo sapiens
YKLNVDQK

SEQ ID NO: 26043 - protein, 15 aa, Homo sapiens
DTALETALNAKAYKR

SEQ ID NO: 26044 - protein, 15 aa, Homo sapiens
DTALETALNAKAYKR

SEQ ID NO: 26045 - protein, 15 aa, Homo sapiens
DTALETALNAKAYKR

SEQ ID NO: 26046 - protein, 15 aa, Homo sapiens
DTALETALNAKAYKR

SEQ ID NO: 26047 - protein, 7 aa, Homo sapiens
KEKAQDR

SEQ ID NO: 26048 - protein, 7 aa, Homo sapiens
KEKAQDR

SEQ ID NO: 26049 - protein, 7 aa, Homo sapiens
KEKAQDR

SEQ ID NO: 26050 - protein, 7 aa, Homo sapiens
KEKAQDR

SEQ ID NO: 26051 - protein, 7 aa, Homo sapiens
KEKAQDR

SEQ ID NO: 26052 - protein, 7 aa, Homo sapiens
KEKAQDR

SEQ ID NO: 26053 - protein, 5 aa, Homo sapiens
IKLGR

SEQ ID NO: 26054 - protein, 7 aa, Homo sapiens
KEKAQDR

SEQ ID NO: 26055 - protein, 5 aa, Homo sapiens
IKLGR

SEQ ID NO: 26056 - protein, 5 aa, Homo sapiens
IKLGR

SEQ ID NO: 26057 - protein, 7 aa, Homo sapiens
VKIKLGR

SEQ ID NO: 26058 - protein, 6 aa, Homo sapiens
IKLGRK

SEQ ID NO: 26059 - protein, 6 aa, Homo sapiens
IKLGRK

SEQ ID NO: 26060 - protein, 7 aa, Homo sapiens
KEKAQDR

SEQ ID NO: 26061 - protein, 7 aa, Homo sapiens
KEKAQDR

SEQ ID NO: 26062 - protein, 9 aa, Homo sapiens
QQKIEQERK

SEQ ID NO: 26063 - protein, 16 aa, Homo sapiens
KRDSDAGSSTPTTSTR

SEQ ID NO: 26064 - protein, 7 aa, Homo sapiens
VKIKLGR

SEQ ID NO: 26065 - protein, 7 aa, Homo sapiens
KEKAQDR

SEQ ID NO: 26066 - protein, 7 aa, Homo sapiens
KEKAQDR

SEQ ID NO: 26067 - protein, 7 aa, Homo sapiens
KEKAQDR

SEQ ID NO: 26068 - protein, 17 aa, Homo sapiens
KKIPDPDSDDVSEVDAR

SEQ ID NO: 26069 - protein, 17 aa, Homo sapiens
VIHVESGKILTGTDAPK

SEQ ID NO: 26070 - protein, 20 aa, Homo sapiens
LMEEDELPSWIIKDDAEVER

SEQ ID NO: 26071 - protein, 20 aa, Homo sapiens
LMEEDELPSWIIKDDAEVER

SEQ ID NO: 26072 - protein, 20 aa, Homo sapiens
LMEEDELPSWIIKDDAEVER

SEQ ID NO: 26073 - protein, 20 aa, Homo sapiens
LMEEDELPSWIIKDDAEVER

SEQ ID NO: 26074 - protein, 17 aa, Homo sapiens
KKIPDPDSDDVSEVDAR

SEQ ID NO: 26075 - protein, 22 aa, Homo sapiens
HIIENAKQDVDDEYGVSQALAR

SEQ ID NO: 26076 - protein, 10 aa, Homo sapiens
VSYKGSPAAR

SEQ ID NO: 26077 - protein, 11 aa, Homo sapiens
KELPEYYELIR

SEQ ID NO: 26078 - protein, 14 aa, Homo sapiens
LTKAVATYHANTER

SEQ ID NO: 26079 - protein, 23 aa, Homo sapiens
ELFQEMNIELVPPYMIASKEAVR

SEQ ID NO: 26080 - protein, 9 aa, Homo sapiens
KEKLPQVTR

SEQ ID NO: 26081 - protein, 9 aa, Homo sapiens
KEKLPQVTR

SEQ ID NO: 26082 - protein, 23 aa, Homo sapiens
ELFQEMNIELVPPYMIASKEAVR

SEQ ID NO: 26083 - protein, 20 aa, Homo sapiens
EKLTELMFEHYNIPAFFLCK

SEQ ID NO: 26084 - protein, 20 aa, Homo sapiens
EKLTELMFEHYNIPAFFLCK

SEQ ID NO: 26085 - protein, 20 aa, Homo sapiens
EKLTELMFEHYNIPAFFLCK

SEQ ID NO: 26086 - protein, 20 aa, Homo sapiens
EKLTELMFEHYNIPAFFLCK

SEQ ID NO: 26087 - protein, 20 aa, Homo sapiens
EKLTELMFEHYNIPAFFLCK

SEQ ID NO: 26088 - protein, 13 aa, Homo sapiens
QEYEEGGKQCVER

SEQ ID NO: 26089 - protein, 13 aa, Homo sapiens
QEYEEGGKQCVER

SEQ ID NO: 26090 - protein, 9 aa, Homo sapiens
KEKLPQVTR

SEQ ID NO: 26091 - protein, 9 aa, Homo sapiens
EGSPANWKR

SEQ ID NO: 26092 - protein, 9 aa, Homo sapiens
EGSPANWKR

SEQ ID NO: 26093 - protein, 9 aa, Homo sapiens
KEKLPQVTR

SEQ ID NO: 26094 - protein, 9 aa, Homo sapiens
KEKLPQVTR

SEQ ID NO: 26095 - protein, 9 aa, Homo sapiens
KEKLPQVTR

SEQ ID NO: 26096 - protein, 9 aa, Homo sapiens
KEKLPQVTR

SEQ ID NO: 26097 - protein, 9 aa, Homo sapiens
EGSPANWKR

SEQ ID NO: 26098 - protein, 9 aa, Homo sapiens
EGSPANWKR

SEQ ID NO: 26099 - protein, 9 aa, Homo sapiens
KEKLPQVTR

SEQ ID NO: 26100 - protein, 9 aa, Homo sapiens
KEKLPQVTR

SEQ ID NO: 26101 - protein, 9 aa, Homo sapiens
KEKLPQVTR

SEQ ID NO: 26102 - protein, 9 aa, Homo sapiens
KEKLPQVTR

SEQ ID NO: 26103 - protein, 9 aa, Homo sapiens
KEKLPQVTR

SEQ ID NO: 26104 - protein, 9 aa, Homo sapiens
KEKLPQVTR

SEQ ID NO: 26105 - protein, 9 aa, Homo sapiens
KEKLPQVTR

SEQ ID NO: 26106 - protein, 9 aa, Homo sapiens
KEKLPQVTR

SEQ ID NO: 26107 - protein, 9 aa, Homo sapiens
KEKLPQVTR

SEQ ID NO: 26108 - protein, 9 aa, Homo sapiens
KEKLPQVTR

SEQ ID NO: 26109 - protein, 9 aa, Homo sapiens
KEKLPQVTR

SEQ ID NO: 26110 - protein, 13 aa, Homo sapiens
EAVREGSPANWKR

SEQ ID NO: 26111 - protein, 9 aa, Homo sapiens
KEKLPQVTR

SEQ ID NO: 26112 - protein, 9 aa, Homo sapiens
KEKLPQVTR

SEQ ID NO: 26113 - protein, 9 aa, Homo sapiens
EGSPANWKR

SEQ ID NO: 26114 - protein, 9 aa, Homo sapiens
KEKLPQVTR

SEQ ID NO: 26115 - protein, 9 aa, Homo sapiens
KEKLPQVTR

SEQ ID NO: 26116 - protein, 9 aa, Homo sapiens
KEKLPQVTR

SEQ ID NO: 26117 - protein, 9 aa, Homo sapiens
KEKLPQVTR

SEQ ID NO: 26118 - protein, 9 aa, Homo sapiens
KEKLPQVTR

SEQ ID NO: 26119 - protein, 9 aa, Homo sapiens
KEKLPQVTR

SEQ ID NO: 26120 - protein, 9 aa, Homo sapiens
KEKLPQVTR

SEQ ID NO: 26121 - protein, 9 aa, Homo sapiens
KEKLPQVTR

SEQ ID NO: 26122 - protein, 9 aa, Homo sapiens
VMATIEKVR

SEQ ID NO: 26123 - protein, 8 aa, Homo sapiens
KVMATIEK

SEQ ID NO: 26124 - protein, 8 aa, Homo sapiens
KVMATIEK

SEQ ID NO: 26125 - protein, 11 aa, Homo sapiens
IYKWVPVTEPK

SEQ ID NO: 26126 - protein, 9 aa, Homo sapiens
VMAAIEKVR

SEQ ID NO: 26127 - protein, 9 aa, Homo sapiens
VMAAIEKVR

SEQ ID NO: 26128 - protein, 9 aa, Homo sapiens
VMAAIEKVR

SEQ ID NO: 26129 - protein, 9 aa, Homo sapiens
VMAAIEKVR

SEQ ID NO: 26130 - protein, 4 aa, Homo sapiens
KWEK

SEQ ID NO: 26131 - protein, 7 aa, Homo sapiens
AKDDIKR

SEQ ID NO: 26132 - protein, 9 aa, Homo sapiens
VMAAIEKVR

SEQ ID NO: 26133 - protein, 9 aa, Homo sapiens
VMAAIEKVR

SEQ ID NO: 26134 - protein, 9 aa, Homo sapiens
VMAAIEKVR

SEQ ID NO: 26135 - protein, 9 aa, Homo sapiens
VMAAIEKVR

SEQ ID NO: 26136 - protein, 7 aa, Homo sapiens
AKDDIKR

SEQ ID NO: 26137 - protein, 9 aa, Homo sapiens
VMAAIEKVR

SEQ ID NO: 26138 - protein, 7 aa, Homo sapiens
AKDDIKR

SEQ ID NO: 26139 - protein, 7 aa, Homo sapiens
AKDDIKR

SEQ ID NO: 26140 - protein, 9 aa, Homo sapiens
VMAAIEKVR

SEQ ID NO: 26141 - protein, 7 aa, Homo sapiens
AKDDIKR

SEQ ID NO: 26142 - protein, 11 aa, Homo sapiens
KWVTVGDTSLR

SEQ ID NO: 26143 - protein, 12 aa, Homo sapiens
DFTDEKEGPITK

SEQ ID NO: 26144 - protein, 12 aa, Homo sapiens
DFTDEKEGPITK

SEQ ID NO: 26145 - protein, 6 aa, Homo sapiens
GSPFKK

SEQ ID NO: 26146 - protein, 16 aa, Homo sapiens
SSTKQPTVGGTSSTPR

SEQ ID NO: 26147 - protein, 16 aa, Homo sapiens
SSTKQPTVGGTSSTPR

SEQ ID NO: 26148 - protein, 17 aa, Homo sapiens
AQKAIVNHPSAALMALR

SEQ ID NO: 26149 - protein, 16 aa, Homo sapiens
SSTKQPTVGGTSSTPR

SEQ ID NO: 26150 - protein, 17 aa, Homo sapiens
AQKAIVNHPSAALMALR

SEQ ID NO: 26151 - protein, 16 aa, Homo sapiens
SSTKQPTVGGTSSTPR

SEQ ID NO: 26152 - protein, 16 aa, Homo sapiens
SSTKQPTVGGTSSTPR

SEQ ID NO: 26153 - protein, 7 aa, Homo sapiens
KFSSFFK

SEQ ID NO: 26154 - protein, 7 aa, Homo sapiens
KFSSFFK

SEQ ID NO: 26155 - protein, 7 aa, Homo sapiens
KFSSFFK

SEQ ID NO: 26156 - protein, 10 aa, Homo sapiens
LLDDPSKQKR

SEQ ID NO: 26157 - protein, 8 aa, Homo sapiens
RKFSSFFK

SEQ ID NO: 26158 - protein, 7 aa, Homo sapiens
KFSSFFK

SEQ ID NO: 26159 - protein, 7 aa, Homo sapiens
KFSSFFK

SEQ ID NO: 26160 - protein, 10 aa, Homo sapiens
KRMEIQEAIK

SEQ ID NO: 26161 - protein, 15 aa, Homo sapiens
IHETIESINQLKTQR

SEQ ID NO: 26162 - protein, 6 aa, Homo sapiens
PLTQKR

SEQ ID NO: 26163 - protein, 6 aa, Homo sapiens
PLTQKR

SEQ ID NO: 26164 - protein, 8 aa, Homo sapiens
YDATKQKR

SEQ ID NO: 26165 - protein, 21 aa, Homo sapiens
TATTQETDGFQVKRPGDVNVR

SEQ ID NO: 26166 - protein, 9 aa, Homo sapiens
YFYSKVQQR

SEQ ID NO: 26167 - protein, 9 aa, Homo sapiens
YFYSKVQQR

SEQ ID NO: 26168 - protein, 19 aa, Homo sapiens
KRPAPQQIQQVQQQAVQNR

SEQ ID NO: 26169 - protein, 8 aa, Homo sapiens
KLDQTIMR

SEQ ID NO: 26170 - protein, 5 aa, Homo sapiens
PIKQK

SEQ ID NO: 26171 - protein, 5 aa, Homo sapiens
PIKQK

SEQ ID NO: 26172 - protein, 16 aa, Homo sapiens
DLKTMTDVVGNPEEER

SEQ ID NO: 26173 - protein, 9 aa, Homo sapiens
MADKILPQR

SEQ ID NO: 26174 - protein, 30 aa, Homo sapiens; identical to SEQ ID NO: 22385

SEQ ID NO: 26175 - protein, 30 aa, Homo sapiens; identical to SEQ ID NO: 22385

SEQ ID NO: 26176 - protein, 30 aa, Homo sapiens; identical to SEQ ID NO: 22385

SEQ ID NO: 26177 - protein, 30 aa, Homo sapiens; identical to SEQ ID NO: 22385

SEQ ID NO: 26178 - protein, 29 aa, Homo sapiens
RKPDGTTTLGLLHPVDPIVGEPGYCPVRL

SEQ ID NO: 26179 - protein, 30 aa, Homo sapiens; identical to SEQ ID NO: 22385

SEQ ID NO: 26180 - protein, 16 aa, Homo sapiens
RDTALETALNAKAYKR

SEQ ID NO: 26181 - protein, 18 aa, Homo sapiens
RLQSGVNTLQGFKEDKRN

SEQ ID NO: 26182 - protein, 18 aa, Homo sapiens
RLQSGVNTLQGFKEDKRN

SEQ ID NO: 26183 - protein, 18 aa, Homo sapiens
RLQSGVNTLQGFKEDKRN

SEQ ID NO: 26184 - protein, 18 aa, Homo sapiens
RLQSGVNTLQGFKEDKRN

SEQ ID NO: 26185 - protein, 18 aa, Homo sapiens
RLQSGVNTLQGFKEDKRN

SEQ ID NO: 26186 - protein, 18 aa, Homo sapiens
RLQSGVNTLQGFKEDKRN

SEQ ID NO: 26187 - protein, 14 aa, Homo sapiens
RLKLIANNTTVERR

SEQ ID NO: 26188 - protein, 14 aa, Homo sapiens
RLKLIANNTTVERR

SEQ ID NO: 26189 - protein, 14 aa, Homo sapiens
RLKLIANNTTVERR

SEQ ID NO: 26190 - protein, 14 aa, Homo sapiens
RLKLIANNTTVERR

SEQ ID NO: 26191 - protein, 20 aa, Homo sapiens
RQKHQEYLNSILQHAKDFKE

SEQ ID NO: 26192 - protein, 18 aa, Homo sapiens
KHQEYLNSILQHAKDFKE

SEQ ID NO: 26193 - protein, 20 aa, Homo sapiens
RQKHQEYLNSILQHAKDFKE

SEQ ID NO: 26194 - protein, 20 aa, Homo sapiens
RQKHQEYLNSILQHAKDFKE

SEQ ID NO: 26195 - protein, 18 aa, Homo sapiens
KHQEYLNSILQHAKDFKE

SEQ ID NO: 26196 - protein, 20 aa, Homo sapiens
RQKHQEYLNSILQHAKDFKE

SEQ ID NO: 26197 - protein, 18 aa, Homo sapiens
KHQEYLNSILQHAKDFKE

SEQ ID NO: 26198 - protein, 22 aa, Homo sapiens
KHQEYLNSILQHAKDFKEYHRS

SEQ ID NO: 26199 - protein, 18 aa, Homo sapiens
KHQEYLNSILQHAKDFKE

SEQ ID NO: 26200 - protein, 22 aa, Homo sapiens
KHQEYLNSILQHAKDFKEYHRS

SEQ ID NO: 26201 - protein, 18 aa, Homo sapiens
KHQEYLNSILQHAKDFKE

SEQ ID NO: 26202 - protein, 18 aa, Homo sapiens
KHQEYLNSILQHAKDFKE

SEQ ID NO: 26203 - protein, 22 aa, Homo sapiens
KHQEYLNSILQHAKDFKEYHRS

SEQ ID NO: 26204 - protein, 22 aa, Homo sapiens
KHQEYLNSILQHAKDFKEYHRS

SEQ ID NO: 26205 - protein, 18 aa, Homo sapiens
KHQEYLNSILQHAKDFKE

SEQ ID NO: 26206 - protein, 22 aa, Homo sapiens
KHQEYLNSILQHAKDFKEYHRS

SEQ ID NO: 26207 - protein, 18 aa, Homo sapiens
KHQEYLNSILQHAKDFKE

SEQ ID NO: 26208 - protein, 18 aa, Homo sapiens
KHQEYLNSILQHAKDFKE

SEQ ID NO: 26209 - protein, 22 aa, Homo sapiens
KHQEYLNSILQHAKDFKEYHRS

SEQ ID NO: 26210 - protein, 18 aa, Homo sapiens
KHQEYLNSILQHAKDFKE

SEQ ID NO: 26211 - protein, 18 aa, Homo sapiens
KHQEYLNSILQHAKDFKE

SEQ ID NO: 26212 - protein, 17 aa, Homo sapiens
RKFLESTDSFNNELKRL

SEQ ID NO: 26213 - protein, 17 aa, Homo sapiens
RKFLESTDSFNNELKRL

SEQ ID NO: 26214 - protein, 17 aa, Homo sapiens
RKFLESTDSFNNELKRL

SEQ ID NO: 26215 - protein, 14 aa, Homo sapiens
RKLEAELLQIEERH

SEQ ID NO: 26216 - protein, 14 aa, Homo sapiens
RKLEAELLQIEERH

SEQ ID NO: 26217 - protein, 14 aa, Homo sapiens
RKLEAELLQIEERH

SEQ ID NO: 26218 - protein, 19 aa, Homo sapiens
RDLKIITDVIGNPEEERRA

SEQ ID NO: 26219 - protein, 19 aa, Homo sapiens
RDLKIITDVIGNPEEERRA

SEQ ID NO: 26220 - protein, 19 aa, Homo sapiens
RDLKIITDVIGNPEEERRA

SEQ ID NO: 26221 - protein, 19 aa, Homo sapiens
RDLKIITDVIGNPEEERRA

SEQ ID NO: 26222 - protein, 17 aa, Homo sapiens
RVASAAAKAALEEFSRV

SEQ ID NO: 26223 - protein, 17 aa, Homo sapiens
RVASAAAKAALEEFSRV

SEQ ID NO: 26224 - protein, 17 aa, Homo sapiens
RVASAAAKAALEEFSRV

SEQ ID NO: 26225 - protein, 17 aa, Homo sapiens
RVASAAAKAALEEFSRV

SEQ ID NO: 26226 - protein, 17 aa, Homo sapiens
KMKEEVPTALVEAHVRK

SEQ ID NO: 26227 - protein, 21 aa, Homo sapiens
RKRPAPQQIQQVQQQAVQNRN

SEQ ID NO: 26228 - protein, 15 aa, Homo sapiens
RDLTDYLMKILTERG

SEQ ID NO: 26229 - protein, 15 aa, Homo sapiens
RDLTDYLMKILTERG

SEQ ID NO: 26230 - protein, 15 aa, Homo sapiens
RDLTDYLMKILTERG

SEQ ID NO: 26231 - protein, 15 aa, Homo sapiens
RDLTDYLMKILTERG

SEQ ID NO: 26232 - protein, 15 aa, Homo sapiens
RDLTDYLMKILTERG

SEQ ID NO: 26233 - protein, 15 aa, Homo sapiens
RDLTDYLMKILTERG

SEQ ID NO: 26234 - protein, 15 aa, Homo sapiens
RDLTDYLMKILTERG

SEQ ID NO: 26235 - protein, 9 aa, Homo sapiens
RAKDDIKRV

SEQ ID NO: 26236 - protein, 10 aa, Homo sapiens
RSVTGKIQKL

SEQ ID NO: 26237 - protein, 20 aa, Homo sapiens
KNHHCKLTQVLNTHYVAPRR

SEQ ID NO: 26238 - protein, 9 aa, Homo sapiens
RAKDDIKRV

SEQ ID NO: 26239 - protein, 17 aa, Homo sapiens
RVASAAAKAALEEFSRV

SEQ ID NO: 26240 - protein, 17 aa, Homo sapiens
RVASAAAKAALEEFSRV

SEQ ID NO: 26241 - protein, 17 aa, Homo sapiens
RVASAAAKAALEEFSRV

SEQ ID NO: 26242 - protein, 17 aa, Homo sapiens
RVASAAAKAALEEFSRV

SEQ ID NO: 26243 - protein, 17 aa, Homo sapiens
KIHETIESINQLKTQRD

SEQ ID NO: 26244 - protein, 19 aa, Homo sapiens
RDLKIITDVIGNPEEERRA

SEQ ID NO: 26245 - protein, 19 aa, Homo sapiens
RDLKIITDVIGNPEEERRA

SEQ ID NO: 26246 - protein, 19 aa, Homo sapiens
RDLKIITDVIGNPEEERRA

SEQ ID NO: 26247 - protein, 19 aa, Homo sapiens
RDLKIITDVIGNPEEERRA

SEQ ID NO: 26248 - protein, 19 aa, Homo sapiens
RDLKIITDVIGNPEEERRA

SEQ ID NO: 26249 - protein, 19 aa, Homo sapiens
RDLKIITDVIGNPEEERRA

SEQ ID NO: 26250 - protein, 19 aa, Homo sapiens
RDLKIITDVIGNPEEERRA

SEQ ID NO: 26251 - protein, 18 aa, Homo sapiens
RDLKIITDVIGNPEEERR

SEQ ID NO: 26252 - protein, 19 aa, Homo sapiens
RDLKIITDVIGNPEEERRA

SEQ ID NO: 26253 - protein, 19 aa, Homo sapiens
RDLKIITDVIGNPEEERRA

SEQ ID NO: 26254 - protein, 18 aa, Homo sapiens
RDLKIITDVIGNPEEERR

SEQ ID NO: 26255 - protein, 18 aa, Homo sapiens
RDLKIITDVIGNPEEERR

SEQ ID NO: 26256 - protein, 19 aa, Homo sapiens
RDLKIITDVIGNPEEERRA

SEQ ID NO: 26257 - protein, 19 aa, Homo sapiens
RDLKIITDVIGNPEEERRA

SEQ ID NO: 26258 - protein, 19 aa, Homo sapiens
RDLKIITDVIGNPEEERRA

SEQ ID NO: 26259 - protein, 18 aa, Homo sapiens
RDLKIITDVIGNPEEERR

SEQ ID NO: 26260 - protein, 19 aa, Homo sapiens
RDLKIITDVIGNPEEERRA

SEQ ID NO: 26261 - protein, 19 aa, Homo sapiens
RDLKIITDVIGNPEEERRA

SEQ ID NO: 26262 - protein, 18 aa, Homo sapiens
RDLKIITDVIGNPEEERR

SEQ ID NO: 26263 - protein, 19 aa, Homo sapiens
RDLKIITDVIGNPEEERRA

SEQ ID NO: 26264 - protein, 19 aa, Homo sapiens
RDLKIITDVIGNPEEERRA

SEQ ID NO: 26265 - protein, 18 aa, Homo sapiens
RDLKIITDVIGNPEEERR

SEQ ID NO: 26266 - protein, 18 aa, Homo sapiens
RDLKIITDVIGNPEEERR

SEQ ID NO: 26267 - protein, 19 aa, Homo sapiens
RDLKIITDVIGNPEEERRA

SEQ ID NO: 26268 - protein, 19 aa, Homo sapiens
RDLKIITDVIGNPEEERRA

SEQ ID NO: 26269 - protein, 18 aa, Homo sapiens
RDLKIITDVIGNPEEERR

SEQ ID NO: 26270 - protein, 19 aa, Homo sapiens
RDLKIITDVIGNPEEERRA

SEQ ID NO: 26271 - protein, 18 aa, Homo sapiens
RDLKIITDVIGNPEEERR

SEQ ID NO: 26272 - protein, 19 aa, Homo sapiens
RDLKIITDVIGNPEEERRA

SEQ ID NO: 26273 - protein, 19 aa, Homo sapiens
RDLKIITDVIGNPEEERRA

SEQ ID NO: 26274 - protein, 19 aa, Homo sapiens
RDLKIITDVIGNPEEERRA

SEQ ID NO: 26275 - protein, 18 aa, Homo sapiens
RDLKIITDVIGNPEEERR

SEQ ID NO: 26276 - protein, 19 aa, Homo sapiens
RDLKIITDVIGNPEEERRA

SEQ ID NO: 26277 - protein, 19 aa, Homo sapiens
RDLKIITDVIGNPEEERRA

SEQ ID NO: 26278 - protein, 19 aa, Homo sapiens
RDLKIITDVIGNPEEERRA

SEQ ID NO: 26279 - protein, 19 aa, Homo sapiens
RDLKIITDVIGNPEEERRA

SEQ ID NO: 26280 - protein, 19 aa, Homo sapiens
RDLKIITDVIGNPEEERRA

SEQ ID NO: 26281 - protein, 19 aa, Homo sapiens
RDLKIITDVIGNPEEERRA

SEQ ID NO: 26282 - protein, 17 aa, Homo sapiens
RSCSNAAFALKQYYLRY

SEQ ID NO: 26283 - protein, 43 aa, Homo sapiens
KVHHFGEDDDEVPPGNPKPQLPIGAIPSSYNYQQHSVSDYLRQ

SEQ ID NO: 26284 - protein, 13 aa, Homo sapiens
RDVHLSKEQESRL

SEQ ID NO: 26285 - protein, 13 aa, Homo sapiens
RDVHLSKEQESRL

SEQ ID NO: 26286 - protein, 18 aa, Homo sapiens
RDLKVMTDVAGNPEEERR

SEQ ID NO: 26287 - protein, 18 aa, Homo sapiens
RDLKVMTDVAGNPEEERR

SEQ ID NO: 26288 - protein, 19 aa, Homo sapiens
RDLKVMTDVAGNPEEERRA

SEQ ID NO: 26289 - protein, 18 aa, Homo sapiens
RDLKVMTDVAGNPEEERR

SEQ ID NO: 26290 - protein, 19 aa, Homo sapiens
RDLKVMTDVAGNPEEERRA

SEQ ID NO: 26291 - protein, 18 aa, Homo sapiens
RDLKVMTDVAGNPEEERR

SEQ ID NO: 26292 - protein, 18 aa, Homo sapiens
RDLKVMTDVAGNPEEERR

SEQ ID NO: 26293 - protein, 18 aa, Homo sapiens
RDLKVMTDVAGNPEEERR

SEQ ID NO: 26294 - protein, 20 aa, Homo sapiens
RAYFDLQTHVIQVPQGKYKV

SEQ ID NO: 26295 - protein, 20 aa, Homo sapiens
RAYFDLQTHVIQVPQGKYKV

SEQ ID NO: 26296 - protein, 20 aa, Homo sapiens
RAYFDLQTHVIQVPQGKYKV

SEQ ID NO: 26297 - protein, 12 aa, Homo sapiens
RTVFPNHTVKRV

SEQ ID NO: 26298 - protein, 17 aa, Homo sapiens
RVASAAAKSALEEFSKM

SEQ ID NO: 26299 - protein, 18 aa, Homo sapiens
RDLKTMTDVVGNPEEERR

SEQ ID NO: 26300 - protein, 18 aa, Homo sapiens
RDLKTMTDVVGNPEEERR

SEQ ID NO: 26301 - protein, 18 aa, Homo sapiens
RDLKTMTDVVGNPEEERR

SEQ ID NO: 26302 - protein, 18 aa, Homo sapiens
RDLKTMTDVVGNPEEERR

SEQ ID NO: 26303 - protein, 18 aa, Homo sapiens
RDLKTMTDVVGNPEEERR

SEQ ID NO: 26304 - protein, 18 aa, Homo sapiens
RDLKTMTDVVGNPEEERR

SEQ ID NO: 26305 - protein, 21 aa, Homo sapiens
RKRPAPQQIQQVQQQAVQNRN

SEQ ID NO: 26306 - protein, 21 aa, Homo sapiens
RKRPAPQQIQQVQQQAVQNRN

SEQ ID NO: 26307 - protein, 21 aa, Homo sapiens
RKRPAPQQIQQVQQQAVQNRN

SEQ ID NO: 26308 - protein, 17 aa, Homo sapiens
RVASAAAKAALEEFSRV

SEQ ID NO: 26309 - protein, 17 aa, Homo sapiens
RVASAAAKAALEEFSRV

SEQ ID NO: 26310 - protein, 18 aa, Homo sapiens
RGQPLPDHLQMAVQGKRP

SEQ ID NO: 26311 - protein, 18 aa, Homo sapiens
RGQPLPDHLQMAVQGKRP

SEQ ID NO: 26312 - protein, 20 aa, Homo sapiens
KPDSPEYKAACKLWDLYLRT

SEQ ID NO: 26313 - protein, 13 aa, Homo sapiens
RYNVPNSAIYKRV

SEQ ID NO: 26314 - protein, 13 aa, Homo sapiens
RYNVPNSAIYKRV

SEQ ID NO: 26315 - protein, 13 aa, Homo sapiens
RYNVPNSAIYKRV

SEQ ID NO: 26316 - protein, 17 aa, Homo sapiens
RLTGPSHSKGSLGEERN

SEQ ID NO: 26317 - protein, 17 aa, Homo sapiens
RLTGPSHSKGSLGEERN

SEQ ID NO: 26318 - protein, 17 aa, Homo sapiens
RLTGPSHSKGSLGEERN

SEQ ID NO: 26319 - protein, 15 aa, Homo sapiens
KKIKLWTMPISSVRF

SEQ ID NO: 26320 - protein, 13 aa, Homo sapiens
RDVHLSKEQESRL

SEQ ID NO: 26321 - protein, 17 aa, Homo sapiens
RVASAAAKSALEEFSKM

SEQ ID NO: 26322 - protein, 17 aa, Homo sapiens
RVASAAAKSALEEFSKM

SEQ ID NO: 26323 - protein, 17 aa, Homo sapiens
KMKEEVPTALVEAHVRK

SEQ ID NO: 26324 - protein, 15 aa, Homo sapiens
KHAEYSVILQEKERQ

SEQ ID NO: 26325 - protein, 11 aa, Homo sapiens
REKEALEQQRQ

SEQ ID NO: 26326 - protein, 15 aa, Homo sapiens
KHAEYSVILQEKERQ

SEQ ID NO: 26327 - protein, 10 aa, Homo sapiens
KRKYPDLERR

SEQ ID NO: 26328 - protein, 21 aa, Homo sapiens
RRAYFDLQTHVIQVPQGKYKV

SEQ ID NO: 26329 - protein, 10 aa, Homo sapiens
KQQKIEQERK

SEQ ID NO: 26330 - protein, 9 aa, Homo sapiens
RKYPDLERR

SEQ ID NO: 26331 - protein, 8 aa, Homo sapiens
RMQVLKRQ

SEQ ID NO: 26332 - protein, 17 aa, Homo sapiens
RVASAAAKSALEEFSKM

SEQ ID NO: 26333 - protein, 17 aa, Homo sapiens
RVASAAAKSALEEFSKM

SEQ ID NO: 26334 - protein, 17 aa, Homo sapiens
RVASAAAKSALEEFSKM

SEQ ID NO: 26335 - protein, 17 aa, Homo sapiens
RVASAAAKSALEEFSKM

SEQ ID NO: 26336 - protein, 19 aa, Homo sapiens
RDLKIITDVIGNPEEERRA

SEQ ID NO: 26337 - protein, 19 aa, Homo sapiens
RDLKIITDVIGNPEEERRA

SEQ ID NO: 26338 - protein, 19 aa, Homo sapiens
RDLKIITDVIGNPEEERRA

SEQ ID NO: 26339 - protein, 19 aa, Homo sapiens
RDLKIITDVIGNPEEERRA

SEQ ID NO: 26340 - protein, 19 aa, Homo sapiens
RDLKIITDVIGNPEEERRA

SEQ ID NO: 26341 - protein, 19 aa, Homo sapiens
RDLKIITDVIGNPEEERRA

SEQ ID NO: 26342 - protein, 21 aa, Homo sapiens
RKRPAPQQIQQVQQQAVQNRN

SEQ ID NO: 26343 - protein, 17 aa, Homo sapiens
RKFLESTDSFNNELKRL

SEQ ID NO: 26344 - protein, 28 aa, Homo sapiens
RKPDGTTTLGLLHPVDPIVGEPGYCPVR

SEQ ID NO: 26345 - protein, 28 aa, Homo sapiens
RKPDGTTTLGLLHPVDPIVGEPGYCPVR

SEQ ID NO: 26346 - protein, 28 aa, Homo sapiens
RKPDGTTTLGLLHPVDPIVGEPGYCPVR

SEQ ID NO: 26347 - protein, 28 aa, Homo sapiens
RKPDGTTTLGLLHPVDPIVGEPGYCPVR

SEQ ID NO: 26348 - protein, 27 aa, Homo sapiens
KPDGTTTLGLLHPVDPIVGEPGYCPVR

SEQ ID NO: 26349 - protein, 28 aa, Homo sapiens
RKPDGTTTLGLLHPVDPIVGEPGYCPVR

SEQ ID NO: 26350 - protein, 14 aa, Homo sapiens
DTALETALNAKAYK

SEQ ID NO: 26351 - protein, 16 aa, Homo sapiens
LQSGVNTLQGFKEDKR

SEQ ID NO: 26352 - protein, 16 aa, Homo sapiens
LQSGVNTLQGFKEDKR

SEQ ID NO: 26353 - protein, 16 aa, Homo sapiens
LQSGVNTLQGFKEDKR

SEQ ID NO: 26354 - protein, 16 aa, Homo sapiens
LQSGVNTLQGFKEDKR

SEQ ID NO: 26355 - protein, 16 aa, Homo sapiens
LQSGVNTLQGFKEDKR

SEQ ID NO: 26356 - protein, 16 aa, Homo sapiens
LQSGVNTLQGFKEDKR

SEQ ID NO: 26357 - protein, 12 aa, Homo sapiens
LKLIANNTTVER

SEQ ID NO: 26358 - protein, 12 aa, Homo sapiens
LKLIANNTTVER

SEQ ID NO: 26359 - protein, 12 aa, Homo sapiens
LKLIANNTTVER

SEQ ID NO: 26360 - protein, 12 aa, Homo sapiens
LKLIANNTTVER

SEQ ID NO: 26361 - protein, 18 aa, Homo sapiens
QKHQEYLNSILQHAKDFK

SEQ ID NO: 26362 - protein, 16 aa, Homo sapiens
HQEYLNSILQHAKDFK

SEQ ID NO: 26363 - protein, 18 aa, Homo sapiens
QKHQEYLNSILQHAKDFK

SEQ ID NO: 26364 - protein, 18 aa, Homo sapiens
QKHQEYLNSILQHAKDFK

SEQ ID NO: 26365 - protein, 16 aa, Homo sapiens
HQEYLNSILQHAKDFK

SEQ ID NO: 26366 - protein, 18 aa, Homo sapiens
QKHQEYLNSILQHAKDFK

SEQ ID NO: 26367 - protein, 16 aa, Homo sapiens
HQEYLNSILQHAKDFK

SEQ ID NO: 26368 - protein, 20 aa, Homo sapiens
HQEYLNSILQHAKDFKEYHR

SEQ ID NO: 26369 - protein, 16 aa, Homo sapiens
HQEYLNSILQHAKDFK

SEQ ID NO: 26370 - protein, 20 aa, Homo sapiens
HQEYLNSILQHAKDFKEYHR

SEQ ID NO: 26371 - protein, 16 aa, Homo sapiens
HQEYLNSILQHAKDFK

SEQ ID NO: 26372 - protein, 16 aa, Homo sapiens
HQEYLNSILQHAKDFK

SEQ ID NO: 26373 - protein, 20 aa, Homo sapiens
HQEYLNSILQHAKDFKEYHR

SEQ ID NO: 26374 - protein, 20 aa, Homo sapiens
HQEYLNSILQHAKDFKEYHR

SEQ ID NO: 26375 - protein, 16 aa, Homo sapiens
HQEYLNSILQHAKDFK

SEQ ID NO: 26376 - protein, 20 aa, Homo sapiens
HQEYLNSILQHAKDFKEYHR

SEQ ID NO: 26377 - protein, 16 aa, Homo sapiens
HQEYLNSILQHAKDFK

SEQ ID NO: 26378 - protein, 16 aa, Homo sapiens
HQEYLNSILQHAKDFK

SEQ ID NO: 26379 - protein, 20 aa, Homo sapiens
HQEYLNSILQHAKDFKEYHR

SEQ ID NO: 26380 - protein, 16 aa, Homo sapiens
HQEYLNSILQHAKDFK

SEQ ID NO: 26381 - protein, 16 aa, Homo sapiens
HQEYLNSILQHAKDFK

SEQ ID NO: 26382 - protein, 15 aa, Homo sapiens
KFLESTDSFNNELKR

SEQ ID NO: 26383 - protein, 15 aa, Homo sapiens
KFLESTDSFNNELKR

SEQ ID NO: 26384 - protein, 15 aa, Homo sapiens
KFLESTDSFNNELKR

SEQ ID NO: 26385 - protein, 12 aa, Homo sapiens
KLEAELLQIEER

SEQ ID NO: 26386 - protein, 12 aa, Homo sapiens
KLEAELLQIEER

SEQ ID NO: 26387 - protein, 12 aa, Homo sapiens
KLEAELLQIEER

SEQ ID NO: 26388 - protein, 17 aa, Homo sapiens
DLKIITDVIGNPEEERR

SEQ ID NO: 26389 - protein, 17 aa, Homo sapiens
DLKIITDVIGNPEEERR

SEQ ID NO: 26390 - protein, 17 aa, Homo sapiens
DLKIITDVIGNPEEERR

SEQ ID NO: 26391 - protein, 17 aa, Homo sapiens
DLKIITDVIGNPEEERR

SEQ ID NO: 26392 - protein, 15 aa, Homo sapiens
VASAAAKAALEEFSR

SEQ ID NO: 26393 - protein, 15 aa, Homo sapiens
VASAAAKAALEEFSR

SEQ ID NO: 26394 - protein, 15 aa, Homo sapiens
VASAAAKAALEEFSR

SEQ ID NO: 26395 - protein, 15 aa, Homo sapiens
VASAAAKAALEEFSR

SEQ ID NO: 26396 - protein, 15 aa, Homo sapiens
MKEEVPTALVEAHVR

SEQ ID NO: 26397 - protein, 19 aa, Homo sapiens
KRPAPQQIQQVQQQAVQNR

SEQ ID NO: 26398 - protein, 13 aa, Homo sapiens
DLTDYLMKILTER

SEQ ID NO: 26399 - protein, 13 aa, Homo sapiens
DLTDYLMKILTER

SEQ ID NO: 26400 - protein, 13 aa, Homo sapiens
DLTDYLMKILTER

SEQ ID NO: 26401 - protein, 13 aa, Homo sapiens
DLTDYLMKILTER

SEQ ID NO: 26402 - protein, 13 aa, Homo sapiens
DLTDYLMKILTER

SEQ ID NO: 26403 - protein, 13 aa, Homo sapiens
DLTDYLMKILTER

SEQ ID NO: 26404 - protein, 13 aa, Homo sapiens
DLTDYLMKILTER

SEQ ID NO: 26405 - protein, 7 aa, Homo sapiens
AKDDIKR

SEQ ID NO: 26406 - protein, 8 aa, Homo sapiens
SVTGKIQK

SEQ ID NO: 26407 - protein, 18 aa, Homo sapiens
NHHCKLTQVLNTHYVAPR

SEQ ID NO: 26408 - protein, 7 aa, Homo sapiens
AKDDIKR

SEQ ID NO: 26409 - protein, 15 aa, Homo sapiens
VASAAAKAALEEFSR

SEQ ID NO: 26410 - protein, 15 aa, Homo sapiens
VASAAAKAALEEFSR

SEQ ID NO: 26411 - protein, 15 aa, Homo sapiens
VASAAAKAALEEFSR

SEQ ID NO: 26412 - protein, 15 aa, Homo sapiens
VASAAAKAALEEFSR

SEQ ID NO: 26413 - protein, 15 aa, Homo sapiens
IHETIESINQLKTQR

SEQ ID NO: 26414 - protein, 17 aa, Homo sapiens
DLKIITDVIGNPEEERR

SEQ ID NO: 26415 - protein, 17 aa, Homo sapiens
DLKIITDVIGNPEEERR

SEQ ID NO: 26416 - protein, 17 aa, Homo sapiens
DLKIITDVIGNPEEERR

SEQ ID NO: 26417 - protein, 17 aa, Homo sapiens
DLKIITDVIGNPEEERR

SEQ ID NO: 26418 - protein, 17 aa, Homo sapiens
DLKIITDVIGNPEEERR

SEQ ID NO: 26419 - protein, 17 aa, Homo sapiens
DLKIITDVIGNPEEERR

SEQ ID NO: 26420 - protein, 17 aa, Homo sapiens
DLKIITDVIGNPEEERR

SEQ ID NO: 26421 - protein, 16 aa, Homo sapiens
DLKIITDVIGNPEEER

SEQ ID NO: 26422 - protein, 17 aa, Homo sapiens
DLKIITDVIGNPEEERR

SEQ ID NO: 26423 - protein, 17 aa, Homo sapiens
DLKIITDVIGNPEEERR

SEQ ID NO: 26424 - protein, 16 aa, Homo sapiens
DLKIITDVIGNPEEER

SEQ ID NO: 26425 - protein, 16 aa, Homo sapiens
DLKIITDVIGNPEEER

SEQ ID NO: 26426 - protein, 17 aa, Homo sapiens
DLKIITDVIGNPEEERR

SEQ ID NO: 26427 - protein, 17 aa, Homo sapiens
DLKIITDVIGNPEEERR

SEQ ID NO: 26428 - protein, 17 aa, Homo sapiens
DLKIITDVIGNPEEERR

SEQ ID NO: 26429 - protein, 16 aa, Homo sapiens
DLKIITDVIGNPEEER

SEQ ID NO: 26430 - protein, 17 aa, Homo sapiens
DLKIITDVIGNPEEERR

SEQ ID NO: 26431 - protein, 17 aa, Homo sapiens
DLKIITDVIGNPEEERR

SEQ ID NO: 26432 - protein, 16 aa, Homo sapiens
DLKIITDVIGNPEEER

SEQ ID NO: 26433 - protein, 17 aa, Homo sapiens
DLKIITDVIGNPEEERR

SEQ ID NO: 26434 - protein, 17 aa, Homo sapiens
DLKIITDVIGNPEEERR

SEQ ID NO: 26435 - protein, 16 aa, Homo sapiens
DLKIITDVIGNPEEER

SEQ ID NO: 26436 - protein, 16 aa, Homo sapiens
DLKIITDVIGNPEEER

SEQ ID NO: 26437 - protein, 17 aa, Homo sapiens
DLKIITDVIGNPEEERR

SEQ ID NO: 26438 - protein, 17 aa, Homo sapiens
DLKIITDVIGNPEEERR

SEQ ID NO: 26439 - protein, 16 aa, Homo sapiens
DLKIITDVIGNPEEER

SEQ ID NO: 26440 - protein, 17 aa, Homo sapiens
DLKIITDVIGNPEEERR

SEQ ID NO: 26441 - protein, 16 aa, Homo sapiens
DLKIITDVIGNPEEER

SEQ ID NO: 26442 - protein, 17 aa, Homo sapiens
DLKIITDVIGNPEEERR

SEQ ID NO: 26443 - protein, 17 aa, Homo sapiens
DLKIITDVIGNPEEERR

SEQ ID NO: 26444 - protein, 17 aa, Homo sapiens
DLKIITDVIGNPEEERR

SEQ ID NO: 26445 - protein, 16 aa, Homo sapiens
DLKIITDVIGNPEEER

SEQ ID NO: 26446 - protein, 17 aa, Homo sapiens
DLKIITDVIGNPEEERR

SEQ ID NO: 26447 - protein, 17 aa, Homo sapiens
DLKIITDVIGNPEEERR

SEQ ID NO: 26448 - protein, 17 aa, Homo sapiens
DLKIITDVIGNPEEERR

SEQ ID NO: 26449 - protein, 17 aa, Homo sapiens
DLKIITDVIGNPEEERR

SEQ ID NO: 26450 - protein, 17 aa, Homo sapiens
DLKIITDVIGNPEEERR

SEQ ID NO: 26451 - protein, 17 aa, Homo sapiens
DLKIITDVIGNPEEERR

SEQ ID NO: 26452 - protein, 15 aa, Homo sapiens
SCSNAAFALKQYYLR

SEQ ID NO: 26453 - protein, 41 aa, Homo sapiens
VHHFGEDDDEVPPGNPKPQLPIGAIPSSYNYQQHSVSDYLR

SEQ ID NO: 26454 - protein, 11 aa, Homo sapiens
DVHLSKEQESR

SEQ ID NO: 26455 - protein, 11 aa, Homo sapiens
DVHLSKEQESR

SEQ ID NO: 26456 - protein, 16 aa, Homo sapiens
DLKVMTDVAGNPEEER

SEQ ID NO: 26457 - protein, 16 aa, Homo sapiens
DLKVMTDVAGNPEEER

SEQ ID NO: 26458 - protein, 17 aa, Homo sapiens
DLKVMTDVAGNPEEERR

SEQ ID NO: 26459 - protein, 16 aa, Homo sapiens
DLKVMTDVAGNPEEER

SEQ ID NO: 26460 - protein, 17 aa, Homo sapiens
DLKVMTDVAGNPEEERR

SEQ ID NO: 26461 - protein, 16 aa, Homo sapiens
DLKVMTDVAGNPEEER

SEQ ID NO: 26462 - protein, 16 aa, Homo sapiens
DLKVMTDVAGNPEEER

SEQ ID NO: 26463 - protein, 16 aa, Homo sapiens
DLKVMTDVAGNPEEER

SEQ ID NO: 26464 - protein, 18 aa, Homo sapiens
AYFDLQTHVIQVPQGKYK

SEQ ID NO: 26465 - protein, 18 aa, Homo sapiens
AYFDLQTHVIQVPQGKYK

SEQ ID NO: 26466 - protein, 18 aa, Homo sapiens
AYFDLQTHVIQVPQGKYK

SEQ ID NO: 26467 - protein, 10 aa, Homo sapiens
TVFPNHTVKR

SEQ ID NO: 26468 - protein, 15 aa, Homo sapiens
VASAAAKSALEEFSK

SEQ ID NO: 26469 - protein, 16 aa, Homo sapiens
DLKTMTDVVGNPEEER

SEQ ID NO: 26470 - protein, 16 aa, Homo sapiens
DLKTMTDVVGNPEEER

SEQ ID NO: 26471 - protein, 16 aa, Homo sapiens
DLKTMTDVVGNPEEER

SEQ ID NO: 26472 - protein, 16 aa, Homo sapiens
DLKTMTDVVGNPEEER

SEQ ID NO: 26473 - protein, 16 aa, Homo sapiens
DLKTMTDVVGNPEEER

SEQ ID NO: 26474 - protein, 16 aa, Homo sapiens
DLKTMTDVVGNPEEER

SEQ ID NO: 26475 - protein, 19 aa, Homo sapiens
KRPAPQQIQQVQQQAVQNR

SEQ ID NO: 26476 - protein, 19 aa, Homo sapiens
KRPAPQQIQQVQQQAVQNR

SEQ ID NO: 26477 - protein, 19 aa, Homo sapiens
KRPAPQQIQQVQQQAVQNR

SEQ ID NO: 26478 - protein, 15 aa, Homo sapiens
VASAAAKAALEEFSR

SEQ ID NO: 26479 - protein, 15 aa, Homo sapiens
VASAAAKAALEEFSR

SEQ ID NO: 26480 - protein, 16 aa, Homo sapiens
GQPLPDHLQMAVQGKR

SEQ ID NO: 26481 - protein, 16 aa, Homo sapiens
GQPLPDHLQMAVQGKR

SEQ ID NO: 26482 - protein, 18 aa, Homo sapiens
PDSPEYKAACKLWDLYLR

SEQ ID NO: 26483 - protein, 11 aa, Homo sapiens
YNVPNSAIYKR

SEQ ID NO: 26484 - protein, 11 aa, Homo sapiens
YNVPNSAIYKR

SEQ ID NO: 26485 - protein, 11 aa, Homo sapiens
YNVPNSAIYKR

SEQ ID NO: 26486 - protein, 15 aa, Homo sapiens
LTGPSHSKGSLGEER

SEQ ID NO: 26487 - protein, 15 aa, Homo sapiens
LTGPSHSKGSLGEER

SEQ ID NO: 26488 - protein, 15 aa, Homo sapiens
LTGPSHSKGSLGEER

SEQ ID NO: 26489 - protein, 13 aa, Homo sapiens
KIKLWTMPISSVR

SEQ ID NO: 26490 - protein, 11 aa, Homo sapiens
DVHLSKEQESR

SEQ ID NO: 26491 - protein, 15 aa, Homo sapiens
VASAAAKSALEEFSK

SEQ ID NO: 26492 - protein, 15 aa, Homo sapiens
VASAAAKSALEEFSK

SEQ ID NO: 26493 - protein, 15 aa, Homo sapiens
MKEEVPTALVEAHVR

SEQ ID NO: 26494 - protein, 13 aa, Homo sapiens
HAEYSVILQEKER

SEQ ID NO: 26495 - protein, 9 aa, Homo sapiens
EKEALEQQR

SEQ ID NO: 26496 - protein, 13 aa, Homo sapiens
HAEYSVILQEKER

SEQ ID NO: 26497 - protein, 8 aa, Homo sapiens
RKYPDLER

SEQ ID NO: 26498 - protein, 19 aa, Homo sapiens
RAYFDLQTHVIQVPQGKYK

SEQ ID NO: 26499 - protein, 8 aa, Homo sapiens
QQKIEQER

SEQ ID NO: 26500 - protein, 7 aa, Homo sapiens
KYPDLER

SEQ ID NO: 26501 - protein, 6 aa, Homo sapiens
MQVLKR

SEQ ID NO: 26502 - protein, 15 aa, Homo sapiens
VASAAAKSALEEFSK

SEQ ID NO: 26503 - protein, 15 aa, Homo sapiens
VASAAAKSALEEFSK

SEQ ID NO: 26504 - protein, 15 aa, Homo sapiens
VASAAAKSALEEFSK

SEQ ID NO: 26505 - protein, 15 aa, Homo sapiens
VASAAAKSALEEFSK

SEQ ID NO: 26506 - protein, 17 aa, Homo sapiens
DLKIITDVIGNPEEERR

SEQ ID NO: 26507 - protein, 17 aa, Homo sapiens
DLKIITDVIGNPEEERR

SEQ ID NO: 26508 - protein, 17 aa, Homo sapiens
DLKIITDVIGNPEEERR

SEQ ID NO: 26509 - protein, 17 aa, Homo sapiens
DLKIITDVIGNPEEERR

SEQ ID NO: 26510 - protein, 17 aa, Homo sapiens
DLKIITDVIGNPEEERR

SEQ ID NO: 26511 - protein, 17 aa, Homo sapiens
DLKIITDVIGNPEEERR

SEQ ID NO: 26512 - protein, 19 aa, Homo sapiens
KRPAPQQIQQVQQQAVQNR

SEQ ID NO: 26513 - protein, 15 aa, Homo sapiens
KFLESTDSFNNELKR

SEQ ID NO: 26514 - protein, 14 aa, Homo sapiens
KEKPVDLQNFGLRT

SEQ ID NO: 26515 - protein, 16 aa, Homo sapiens
KNKEKPVDLQNFGLRT

SEQ ID NO: 26516 - protein, 14 aa, Homo sapiens
KEKPVDLQNFGLRT

SEQ ID NO: 26517 - protein, 16 aa, Homo sapiens
KNKEKPVDLQNFGLRT

SEQ ID NO: 26518 - protein, 14 aa, Homo sapiens
KEKPVDLQNFGLRT

SEQ ID NO: 26519 - protein, 16 aa, Homo sapiens
KNKEKPVDLQNFGLRT

SEQ ID NO: 26520 - protein, 6 aa, Homo sapiens
KEDKRN

SEQ ID NO: 26521 - protein, 17 aa, Homo sapiens
RRDTALETALNAKAYKR

SEQ ID NO: 26522 - protein, 17 aa, Homo sapiens
RRDTALETALNAKAYKR

SEQ ID NO: 26523 - protein, 17 aa, Homo sapiens
RRDTALETALNAKAYKR

SEQ ID NO: 26524 - protein, 17 aa, Homo sapiens
RDTALETALNAKAYKRS

SEQ ID NO: 26525 - protein, 17 aa, Homo sapiens
RRDTALETALNAKAYKR

SEQ ID NO: 26526 - protein, 17 aa, Homo sapiens
RDTALETALNAKAYKRS

SEQ ID NO: 26527 - protein, 9 aa, Homo sapiens
KDFKEYHRS

SEQ ID NO: 26528 - protein, 9 aa, Homo sapiens
KDFKEYHRS

SEQ ID NO: 26529 - protein, 9 aa, Homo sapiens
KDFKEYHRS

SEQ ID NO: 26530 - protein, 9 aa, Homo sapiens
KDFKEYHRS

SEQ ID NO: 26531 - protein, 14 aa, Homo sapiens
RLKLIANNTTVERR

SEQ ID NO: 26532 - protein, 14 aa, Homo sapiens
RLKLIANNTTVERR

SEQ ID NO: 26533 - protein, 14 aa, Homo sapiens
RLKLIANNTTVERR

SEQ ID NO: 26534 - protein, 14 aa, Homo sapiens
RLKLIANNTTVERR

SEQ ID NO: 26535 - protein, 14 aa, Homo sapiens
RLKLIANNTTVERR

SEQ ID NO: 26536 - protein, 14 aa, Homo sapiens
RLKLIANNTTVERR

SEQ ID NO: 26537 - protein, 14 aa, Homo sapiens
RLKLIANNTTVERR

SEQ ID NO: 26538 - protein, 14 aa, Homo sapiens
RLKLIANNTTVERR

SEQ ID NO: 26539 - protein, 14 aa, Homo sapiens
RLKLIANNTTVERR

SEQ ID NO: 26540 - protein, 14 aa, Homo sapiens
RLKLIANNTTVERR

SEQ ID NO: 26541 - protein, 14 aa, Homo sapiens
RLKLIANNTTVERR

SEQ ID NO: 26542 - protein, 14 aa, Homo sapiens
RLKLIANNTTVERR

SEQ ID NO: 26543 - protein, 14 aa, Homo sapiens
RLKLIANNTTVERR

SEQ ID NO: 26544 - protein, 14 aa, Homo sapiens
RLKLIANNTTVERR

SEQ ID NO: 26545 - protein, 14 aa, Homo sapiens
RLKLIANNTTVERR

SEQ ID NO: 26546 - protein, 14 aa, Homo sapiens
RLKLIANNTTVERR

SEQ ID NO: 26547 - protein, 14 aa, Homo sapiens
RLKLIANNTTVERR

SEQ ID NO: 26548 - protein, 14 aa, Homo sapiens
RLKLIANNTTVERR

SEQ ID NO: 26549 - protein, 14 aa, Homo sapiens
RLKLIANNTTVERR

SEQ ID NO: 26550 - protein, 14 aa, Homo sapiens
RLKLIANNTTVERR

SEQ ID NO: 26551 - protein, 15 aa, Homo sapiens
RLKLIANNTTVERRF

SEQ ID NO: 26552 - protein, 11 aa, Homo sapiens
REKEALEQQRQ

SEQ ID NO: 26553 - protein, 11 aa, Homo sapiens
REKEALEQQRQ

SEQ ID NO: 26554 - protein, 11 aa, Homo sapiens
REKEALEQQRQ

SEQ ID NO: 26555 - protein, 7 aa, Homo sapiens
KKLEIKL

SEQ ID NO: 26556 - protein, 7 aa, Homo sapiens
KKLEIKL

SEQ ID NO: 26557 - protein, 7 aa, Homo sapiens
KKLEIKL

SEQ ID NO: 26558 - protein, 17 aa, Homo sapiens
RVASAAAKAALEEFSRV

SEQ ID NO: 26559 - protein, 17 aa, Homo sapiens
RVASAAAKAALEEFSRV

SEQ ID NO: 26560 - protein, 17 aa, Homo sapiens
RVASAAAKAALEEFSRV

SEQ ID NO: 26561 - protein, 17 aa, Homo sapiens
RVASAAAKAALEEFSRV

SEQ ID NO: 26562 - protein, 7 aa, Homo sapiens
KTKVERD

SEQ ID NO: 26563 - protein, 17 aa, Homo sapiens
RVASAAAKSALEEFSKM

SEQ ID NO: 26564 - protein, 17 aa, Homo sapiens
RVASAAAKSALEEFSKM

SEQ ID NO: 26565 - protein, 17 aa, Homo sapiens
RVASAAAKSALEEFSKM

SEQ ID NO: 26566 - protein, 17 aa, Homo sapiens
RVASAAAKAALEEFSRV

SEQ ID NO: 26567 - protein, 12 aa, Homo sapiens
KAKHLAAVEERK

SEQ ID NO: 26568 - protein, 11 aa, Homo sapiens
RKEKLPQVTRS

SEQ ID NO: 26569 - protein, 10 aa, Homo sapiens
KEKLPQVTRS

SEQ ID NO: 26570 - protein, 11 aa, Homo sapiens
RKEKLPQVTRS

SEQ ID NO: 26571 - protein, 10 aa, Homo sapiens
KEKLPQVTRS

SEQ ID NO: 26572 - protein, 10 aa, Homo sapiens
KEKLPQVTRS

SEQ ID NO: 26573 - protein, 10 aa, Homo sapiens
KEKLPQVTRS

SEQ ID NO: 26574 - protein, 11 aa, Homo sapiens
RKEKLPQVTRS

SEQ ID NO: 26575 - protein, 8 aa, Homo sapiens
KIQKLTKA

SEQ ID NO: 26576 - protein, 9 aa, Homo sapiens
RAKDDIKRV

SEQ ID NO: 26577 - protein, 5 aa, Homo sapiens
MSGRG

SEQ ID NO: 26578 - protein, 8 aa, Homo sapiens
KIQKLSKA

SEQ ID NO: 26579 - protein, 13 aa, Homo sapiens
RKLGINDIEGQRV

SEQ ID NO: 26580 - protein, 13 aa, Homo sapiens
RKLGINDIEGQRV

SEQ ID NO: 26581 - protein, 13 aa, Homo sapiens
RKLGINDIEGQRV

SEQ ID NO: 26582 - protein, 13 aa, Homo sapiens
RKLGINDIEGQRV

SEQ ID NO: 26583 - protein, 13 aa, Homo sapiens
RKLGINDIEGQRV

SEQ ID NO: 26584 - protein, 13 aa, Homo sapiens
RKLGINDIEGQRV

SEQ ID NO: 26585 - protein, 13 aa, Homo sapiens
RKLGINDIEGQRV

SEQ ID NO: 26586 - protein, 13 aa, Homo sapiens
RKLGINDIEGQRV

SEQ ID NO: 26587 - protein, 13 aa, Homo sapiens
RKLGINDIEGQRV

SEQ ID NO: 26588 - protein, 13 aa, Homo sapiens
RKLGINDIEGQRV

SEQ ID NO: 26589 - protein, 13 aa, Homo sapiens
RKLGINDIEGQRV

SEQ ID NO: 26590 - protein, 13 aa, Homo sapiens
RKLGINDIEGQRV

SEQ ID NO: 26591 - protein, 13 aa, Homo sapiens
RKLGINDIEGQRV

SEQ ID NO: 26592 - protein, 13 aa, Homo sapiens
RKLGINDIEGQRV

SEQ ID NO: 26593 - protein, 13 aa, Homo sapiens
RKLGINDIEGQRV

SEQ ID NO: 26594 - protein, 13 aa, Homo sapiens
RKLGINDIEGQRV

SEQ ID NO: 26595 - protein, 13 aa, Homo sapiens
RKLGINDIEGQRV

SEQ ID NO: 26596 - protein, 13 aa, Homo sapiens
RKLGINDIEGQRV

SEQ ID NO: 26597 - protein, 13 aa, Homo sapiens
RKLGINDIEGQRV

SEQ ID NO: 26598 - protein, 13 aa, Homo sapiens
RKLGINDIEGQRV

SEQ ID NO: 26599 - protein, 13 aa, Homo sapiens
RKLGINDIEGQRV

SEQ ID NO: 26600 - protein, 13 aa, Homo sapiens
RKLGINDIEGQRV

SEQ ID NO: 26601 - protein, 13 aa, Homo sapiens
RKLGINDIEGQRV

SEQ ID NO: 26602 - protein, 13 aa, Homo sapiens
RKLGINDIEGQRV

SEQ ID NO: 26603 - protein, 13 aa, Homo sapiens
RKLGINDIEGQRV

SEQ ID NO: 26604 - protein, 13 aa, Homo sapiens
RKLGINDIEGQRV

SEQ ID NO: 26605 - protein, 13 aa, Homo sapiens
RKLGINDIEGQRV

SEQ ID NO: 26606 - protein, 13 aa, Homo sapiens
RKLGINDIEGQRV

SEQ ID NO: 26607 - protein, 13 aa, Homo sapiens
RKLGINDIEGQRV

SEQ ID NO: 26608 - protein, 13 aa, Homo sapiens
RKLGINDIEGQRV

SEQ ID NO: 26609 - protein, 13 aa, Homo sapiens
RKLGINDIEGQRV

SEQ ID NO: 26610 - protein, 13 aa, Homo sapiens
RKLGINDIEGQRV

SEQ ID NO: 26611 - protein, 13 aa, Homo sapiens
RKLGINDIEGQRV

SEQ ID NO: 26612 - protein, 13 aa, Homo sapiens
RKLGINDIEGQRV

SEQ ID NO: 26613 - protein, 13 aa, Homo sapiens
RKLGINDIEGQRV

SEQ ID NO: 26614 - protein, 13 aa, Homo sapiens
RKLGINDIEGQRV

SEQ ID NO: 26615 - protein, 13 aa, Homo sapiens
RKLGINDIEGQRV

SEQ ID NO: 26616 - protein, 13 aa, Homo sapiens
RKLGINDIEGQRV

SEQ ID NO: 26617 - protein, 13 aa, Homo sapiens
RKLGINDIEGQRV

SEQ ID NO: 26618 - protein, 13 aa, Homo sapiens
RKLGINDIEGQRV

SEQ ID NO: 26619 - protein, 13 aa, Homo sapiens
RKLGINDIEGQRV

SEQ ID NO: 26620 - protein, 13 aa, Homo sapiens
RKLGINDIEGQRV

SEQ ID NO: 26621 - protein, 13 aa, Homo sapiens
RKLGINDIEGQRV

SEQ ID NO: 26622 - protein, 5 aa, Homo sapiens
KKIRD

SEQ ID NO: 26623 - protein, 13 aa, Homo sapiens
RLDMEIDGQKLRD

SEQ ID NO: 26624 - protein, 12 aa, Homo sapiens
RTVFPNHTVKRV

SEQ ID NO: 26625 - protein, 12 aa, Homo sapiens
RTVFPNHTVKRV

SEQ ID NO: 26626 - protein, 13 aa, Homo sapiens
RKLGINDIEGQRV

SEQ ID NO: 26627 - protein, 13 aa, Homo sapiens
RKLGINDIEGQRV

SEQ ID NO: 26628 - protein, 13 aa, Homo sapiens
RKLGINDIEGQRV

SEQ ID NO: 26629 - protein, 13 aa, Homo sapiens
RKLGINDIEGQRV

SEQ ID NO: 26630 - protein, 13 aa, Homo sapiens
RKLGINDIEGQRV

SEQ ID NO: 26631 - protein, 13 aa, Homo sapiens
RKLGINDIEGQRV

SEQ ID NO: 26632 - protein, 13 aa, Homo sapiens
RKLGINDIEGQRV

SEQ ID NO: 26633 - protein, 13 aa, Homo sapiens
RKLGINDIEGQRV

SEQ ID NO: 26634 - protein, 19 aa, Homo sapiens
KIPAVGGKELDLHGLYTRV

SEQ ID NO: 26635 - protein, 19 aa, Homo sapiens
KIPAVGGKELDLHGLYTRV

SEQ ID NO: 26636 - protein, 19 aa, Homo sapiens
KIPAVGGKELDLHGLYTRV

SEQ ID NO: 26637 - protein, 6 aa, Homo sapiens
RKVGRR

SEQ ID NO: 26638 - protein, 13 aa, Homo sapiens
RKLGINDIEGQRV

SEQ ID NO: 26639 - protein, 13 aa, Homo sapiens
RKLGINDIEGQRV

SEQ ID NO: 26640 - protein, 13 aa, Homo sapiens
RKLGINDIEGQRV

SEQ ID NO: 26641 - protein, 13 aa, Homo sapiens
RKLGINDIEGQRV

SEQ ID NO: 26642 - protein, 13 aa, Homo sapiens
RKLGINDIEGQRV

SEQ ID NO: 26643 - protein, 13 aa, Homo sapiens
RKLGINDIEGQRV

SEQ ID NO: 26644 - protein, 13 aa, Homo sapiens
RKLGINDIEGQRV

SEQ ID NO: 26645 - protein, 14 aa, Homo sapiens
RDFTDEKEGPITKH

SEQ ID NO: 26646 - protein, 14 aa, Homo sapiens
RDFTDEKEGPITKH

SEQ ID NO: 26647 - protein, 14 aa, Homo sapiens
RDFTDEKEGPITKH

SEQ ID NO: 26648 - protein, 13 aa, Homo sapiens
RDVHLSKEQESRL

SEQ ID NO: 26649 - protein, 13 aa, Homo sapiens
RDVHLSKEQESRL

SEQ ID NO: 26650 - protein, 13 aa, Homo sapiens
RDVHLSKEQESRL

SEQ ID NO: 26651 - protein, 13 aa, Homo sapiens
RDVHLSKEQESRL

SEQ ID NO: 26652 - protein, 8 aa, Homo sapiens
KEKLYLRE

SEQ ID NO: 26653 - protein, 6 aa, Homo sapiens
RKVGRR

SEQ ID NO: 26654 - protein, 6 aa, Homo sapiens
RKVGRR

SEQ ID NO: 26655 - protein, 6 aa, Homo sapiens
RKVGRR

SEQ ID NO: 26656 - protein, 6 aa, Homo sapiens
RKVGRR

SEQ ID NO: 26657 - protein, 6 aa, Homo sapiens
RKVGRR

SEQ ID NO: 26658 - protein, 6 aa, Homo sapiens
RKVGRR

SEQ ID NO: 26659 - protein, 12 aa, Homo sapiens
RKRMEIQEAIKK

SEQ ID NO: 26660 - protein, 7 aa, Homo sapiens
KTKVERD

SEQ ID NO: 26661 - protein, 13 aa, Homo sapiens
RDVHLSKEQESRL

SEQ ID NO: 26662 - protein, 13 aa, Homo sapiens
RDVHLSKEQESRL

SEQ ID NO: 26663 - protein, 13 aa, Homo sapiens
RDVHLSKEQESRL

SEQ ID NO: 26664 - protein, 9 aa, Homo sapiens
RKASANARK

SEQ ID NO: 26665 - protein, 11 aa, Homo sapiens
KSKDKAATPRK

SEQ ID NO: 26666 - protein, 8 aa, Homo sapiens
RGSLYKRY

SEQ ID NO: 26667 - protein, 8 aa, Homo sapiens
RGSLYKRY

SEQ ID NO: 26668 - protein, 12 aa, Homo sapiens
KENSPEKFALKL

SEQ ID NO: 26669 - protein, 6 aa, Homo sapiens
RKVGRR

SEQ ID NO: 26670 - protein, 7 aa, Homo sapiens
RIEKERM

SEQ ID NO: 26671 - protein, 9 aa, Homo sapiens
RKVEEAAKV

SEQ ID NO: 26672 - protein, 13 aa, Homo sapiens
RDPKGYVQDLLRS

SEQ ID NO: 26673 - protein, 13 aa, Homo sapiens
RDPKGYVQDLLRS

SEQ ID NO: 26674 - protein, 13 aa, Homo sapiens
RDPKGYVQDLLRS

SEQ ID NO: 26675 - protein, 13 aa, Homo sapiens
RDPKGYVQDLLRS

SEQ ID NO: 26676 - protein, 17 aa, Homo sapiens
RVASAAAKSALEEFSKM

SEQ ID NO: 26677 - protein, 17 aa, Homo sapiens
RVASAAAKSALEEFSKM

SEQ ID NO: 26678 - protein, 17 aa, Homo sapiens
RVASAAAKSALEEFSKM

SEQ ID NO: 26679 - protein, 17 aa, Homo sapiens
RVASAAAKSALEEFSKM

SEQ ID NO: 26680 - protein, 17 aa, Homo sapiens
RVASAAAKSALEEFSKM

SEQ ID NO: 26681 - protein, 17 aa, Homo sapiens
RVASAAAKSALEEFSKM

SEQ ID NO: 26682 - protein, 14 aa, Homo sapiens
RKLEAELLQIEERH

SEQ ID NO: 26683 - protein, 16 aa, Homo sapiens
RLLEDSALSKYDATKQ

SEQ ID NO: 26684 - protein, 12 aa, Homo sapiens
EKPVDLQNFGLR

SEQ ID NO: 26685 - protein, 14 aa, Homo sapiens
NKEKPVDLQNFGLR

SEQ ID NO: 26686 - protein, 12 aa, Homo sapiens
EKPVDLQNFGLR

SEQ ID NO: 26687 - protein, 14 aa, Homo sapiens
NKEKPVDLQNFGLR

SEQ ID NO: 26688 - protein, 12 aa, Homo sapiens
EKPVDLQNFGLR

SEQ ID NO: 26689 - protein, 14 aa, Homo sapiens
NKEKPVDLQNFGLR

SEQ ID NO: 26690 - protein, 4 aa, Homo sapiens
EDKR

SEQ ID NO: 26691 - protein, 15 aa, Homo sapiens
RDTALETALNAKAYK

SEQ ID NO: 26692 - protein, 15 aa, Homo sapiens
RDTALETALNAKAYK

SEQ ID NO: 26693 - protein, 15 aa, Homo sapiens
RDTALETALNAKAYK

SEQ ID NO: 26694 - protein, 15 aa, Homo sapiens
DTALETALNAKAYKR

SEQ ID NO: 26695 - protein, 15 aa, Homo sapiens
RDTALETALNAKAYK

SEQ ID NO: 26696 - protein, 15 aa, Homo sapiens
DTALETALNAKAYKR

SEQ ID NO: 26697 - protein, 7 aa, Homo sapiens
DFKEYHR

SEQ ID NO: 26698 - protein, 7 aa, Homo sapiens
DFKEYHR

SEQ ID NO: 26699 - protein, 7 aa, Homo sapiens
DFKEYHR

SEQ ID NO: 26700 - protein, 7 aa, Homo sapiens
DFKEYHR

SEQ ID NO: 26701 - protein, 12 aa, Homo sapiens
LKLIANNTTVER

SEQ ID NO: 26702 - protein, 12 aa, Homo sapiens
LKLIANNTTVER

SEQ ID NO: 26703 - protein, 12 aa, Homo sapiens
LKLIANNTTVER

SEQ ID NO: 26704 - protein, 12 aa, Homo sapiens
LKLIANNTTVER

SEQ ID NO: 26705 - protein, 12 aa, Homo sapiens
LKLIANNTTVER

SEQ ID NO: 26706 - protein, 12 aa, Homo sapiens
LKLIANNTTVER

SEQ ID NO: 26707 - protein, 12 aa, Homo sapiens
LKLIANNTTVER

SEQ ID NO: 26708 - protein, 12 aa, Homo sapiens
LKLIANNTTVER

SEQ ID NO: 26709 - protein, 12 aa, Homo sapiens
LKLIANNTTVER

SEQ ID NO: 26710 - protein, 12 aa, Homo sapiens
LKLIANNTTVER

SEQ ID NO: 26711 - protein, 12 aa, Homo sapiens
LKLIANNTTVER

SEQ ID NO: 26712 - protein, 12 aa, Homo sapiens
LKLIANNTTVER

SEQ ID NO: 26713 - protein, 12 aa, Homo sapiens
LKLIANNTTVER

SEQ ID NO: 26714 - protein, 12 aa, Homo sapiens
LKLIANNTTVER

SEQ ID NO: 26715 - protein, 12 aa, Homo sapiens
LKLIANNTTVER

SEQ ID NO: 26716 - protein, 12 aa, Homo sapiens
LKLIANNTTVER

SEQ ID NO: 26717 - protein, 12 aa, Homo sapiens
LKLIANNTTVER

SEQ ID NO: 26718 - protein, 12 aa, Homo sapiens
LKLIANNTTVER

SEQ ID NO: 26719 - protein, 12 aa, Homo sapiens
LKLIANNTTVER

SEQ ID NO: 26720 - protein, 12 aa, Homo sapiens
LKLIANNTTVER

SEQ ID NO: 26721 - protein, 13 aa, Homo sapiens
LKLIANNTTVERR

SEQ ID NO: 26722 - protein, 9 aa, Homo sapiens
EKEALEQQR

SEQ ID NO: 26723 - protein, 9 aa, Homo sapiens
EKEALEQQR

SEQ ID NO: 26724 - protein, 9 aa, Homo sapiens
EKEALEQQR

SEQ ID NO: 26725 - protein, 5 aa, Homo sapiens
KLEIK

SEQ ID NO: 26726 - protein, 5 aa, Homo sapiens
KLEIK

SEQ ID NO: 26727 - protein, 5 aa, Homo sapiens
KLEIK

SEQ ID NO: 26728 - protein, 15 aa, Homo sapiens
VASAAAKAALEEFSR

SEQ ID NO: 26729 - protein, 15 aa, Homo sapiens
VASAAAKAALEEFSR

SEQ ID NO: 26730 - protein, 15 aa, Homo sapiens
VASAAAKAALEEFSR

SEQ ID NO: 26731 - protein, 15 aa, Homo sapiens
VASAAAKAALEEFSR

SEQ ID NO: 26732 - protein, 5 aa, Homo sapiens
TKVER

SEQ ID NO: 26733 - protein, 15 aa, Homo sapiens
VASAAAKSALEEFSK

SEQ ID NO: 26734 - protein, 15 aa, Homo sapiens
VASAAAKSALEEFSK

SEQ ID NO: 26735 - protein, 15 aa, Homo sapiens
VASAAAKSALEEFSK

SEQ ID NO: 26736 - protein, 15 aa, Homo sapiens
VASAAAKAALEEFSR

SEQ ID NO: 26737 - protein, 10 aa, Homo sapiens
AKHLAAVEER

SEQ ID NO: 26738 - protein, 9 aa, Homo sapiens
KEKLPQVTR

SEQ ID NO: 26739 - protein, 8 aa, Homo sapiens
EKLPQVTR

SEQ ID NO: 26740 - protein, 9 aa, Homo sapiens
KEKLPQVTR

SEQ ID NO: 26741 - protein, 8 aa, Homo sapiens
EKLPQVTR

SEQ ID NO: 26742 - protein, 8 aa, Homo sapiens
EKLPQVTR

SEQ ID NO: 26743 - protein, 8 aa, Homo sapiens
EKLPQVTR

SEQ ID NO: 26744 - protein, 9 aa, Homo sapiens
KEKLPQVTR

SEQ ID NO: 26745 - protein, 6 aa, Homo sapiens
IQKLTK

SEQ ID NO: 26746 - protein, 7 aa, Homo sapiens
AKDDIKR

SEQ ID NO: 26747 - protein, 4 aa, Homo sapiens
MSGR

SEQ ID NO: 26748 - protein, 6 aa, Homo sapiens
IQKLSK

SEQ ID NO: 26749 - protein, 11 aa, Homo sapiens
KLGINDIEGQR

SEQ ID NO: 26750 - protein, 11 aa, Homo sapiens
KLGINDIEGQR

SEQ ID NO: 26751 - protein, 11 aa, Homo sapiens
KLGINDIEGQR

SEQ ID NO: 26752 - protein, 11 aa, Homo sapiens
KLGINDIEGQR

SEQ ID NO: 26753 - protein, 11 aa, Homo sapiens
KLGINDIEGQR

SEQ ID NO: 26754 - protein, 11 aa, Homo sapiens
KLGINDIEGQR

SEQ ID NO: 26755 - protein, 11 aa, Homo sapiens
KLGINDIEGQR

SEQ ID NO: 26756 - protein, 11 aa, Homo sapiens
KLGINDIEGQR

SEQ ID NO: 26757 - protein, 11 aa, Homo sapiens
KLGINDIEGQR

SEQ ID NO: 26758 - protein, 11 aa, Homo sapiens
KLGINDIEGQR

SEQ ID NO: 26759 - protein, 11 aa, Homo sapiens
KLGINDIEGQR

SEQ ID NO: 26760 - protein, 11 aa, Homo sapiens
KLGINDIEGQR

SEQ ID NO: 26761 - protein, 11 aa, Homo sapiens
KLGINDIEGQR

SEQ ID NO: 26762 - protein, 11 aa, Homo sapiens
KLGINDIEGQR

SEQ ID NO: 26763 - protein, 11 aa, Homo sapiens
KLGINDIEGQR

SEQ ID NO: 26764 - protein, 11 aa, Homo sapiens
KLGINDIEGQR

SEQ ID NO: 26765 - protein, 11 aa, Homo sapiens
KLGINDIEGQR

SEQ ID NO: 26766 - protein, 11 aa, Homo sapiens
KLGINDIEGQR

SEQ ID NO: 26767 - protein, 11 aa, Homo sapiens
KLGINDIEGQR

SEQ ID NO: 26768 - protein, 11 aa, Homo sapiens
KLGINDIEGQR

SEQ ID NO: 26769 - protein, 11 aa, Homo sapiens
KLGINDIEGQR

SEQ ID NO: 26770 - protein, 11 aa, Homo sapiens
KLGINDIEGQR

SEQ ID NO: 26771 - protein, 11 aa, Homo sapiens
KLGINDIEGQR

SEQ ID NO: 26772 - protein, 11 aa, Homo sapiens
KLGINDIEGQR

SEQ ID NO: 26773 - protein, 11 aa, Homo sapiens
KLGINDIEGQR

SEQ ID NO: 26774 - protein, 11 aa, Homo sapiens
KLGINDIEGQR

SEQ ID NO: 26775 - protein, 11 aa, Homo sapiens
KLGINDIEGQR

SEQ ID NO: 26776 - protein, 11 aa, Homo sapiens
KLGINDIEGQR

SEQ ID NO: 26777 - protein, 11 aa, Homo sapiens
KLGINDIEGQR

SEQ ID NO: 26778 - protein, 11 aa, Homo sapiens
KLGINDIEGQR

SEQ ID NO: 26779 - protein, 11 aa, Homo sapiens
KLGINDIEGQR

SEQ ID NO: 26780 - protein, 11 aa, Homo sapiens
KLGINDIEGQR

SEQ ID NO: 26781 - protein, 11 aa, Homo sapiens
KLGINDIEGQR

SEQ ID NO: 26782 - protein, 11 aa, Homo sapiens
KLGINDIEGQR

SEQ ID NO: 26783 - protein, 11 aa, Homo sapiens
KLGINDIEGQR

SEQ ID NO: 26784 - protein, 11 aa, Homo sapiens
KLGINDIEGQR

SEQ ID NO: 26785 - protein, 11 aa, Homo sapiens
KLGINDIEGQR

SEQ ID NO: 26786 - protein, 11 aa, Homo sapiens
KLGINDIEGQR

SEQ ID NO: 26787 - protein, 11 aa, Homo sapiens
KLGINDIEGQR

SEQ ID NO: 26788 - protein, 11 aa, Homo sapiens
KLGINDIEGQR

SEQ ID NO: 26789 - protein, 11 aa, Homo sapiens
KLGINDIEGQR

SEQ ID NO: 26790 - protein, 11 aa, Homo sapiens
KLGINDIEGQR

SEQ ID NO: 26791 - protein, 11 aa, Homo sapiens
KLGINDIEGQR

SEQ ID NO: 26792 - protein, 3 aa, Homo sapiens
KIR

SEQ ID NO: 26793 - protein, 11 aa, Homo sapiens
LDMEIDGQKLR

SEQ ID NO: 26794 - protein, 10 aa, Homo sapiens
TVFPNHTVKR

SEQ ID NO: 26795 - protein, 10 aa, Homo sapiens
TVFPNHTVKR

SEQ ID NO: 26796 - protein, 11 aa, Homo sapiens
KLGINDIEGQR

SEQ ID NO: 26797 - protein, 11 aa, Homo sapiens
KLGINDIEGQR

SEQ ID NO: 26798 - protein, 11 aa, Homo sapiens
KLGINDIEGQR

SEQ ID NO: 26799 - protein, 11 aa, Homo sapiens
KLGINDIEGQR

SEQ ID NO: 26800 - protein, 11 aa, Homo sapiens
KLGINDIEGQR

SEQ ID NO: 26801 - protein, 11 aa, Homo sapiens
KLGINDIEGQR

SEQ ID NO: 26802 - protein, 11 aa, Homo sapiens
KLGINDIEGQR

SEQ ID NO: 26803 - protein, 11 aa, Homo sapiens
KLGINDIEGQR

SEQ ID NO: 26804 - protein, 17 aa, Homo sapiens
IPAVGGKELDLHGLYTR

SEQ ID NO: 26805 - protein, 17 aa, Homo sapiens
IPAVGGKELDLHGLYTR

SEQ ID NO: 26806 - protein, 17 aa, Homo sapiens
IPAVGGKELDLHGLYTR

SEQ ID NO: 26807 - protein, 4 aa, Homo sapiens
KVGR

SEQ ID NO: 26808 - protein, 11 aa, Homo sapiens
KLGINDIEGQR

SEQ ID NO: 26809 - protein, 11 aa, Homo sapiens
KLGINDIEGQR

SEQ ID NO: 26810 - protein, 11 aa, Homo sapiens
KLGINDIEGQR

SEQ ID NO: 26811 - protein, 11 aa, Homo sapiens
KLGINDIEGQR

SEQ ID NO: 26812 - protein, 11 aa, Homo sapiens
KLGINDIEGQR

SEQ ID NO: 26813 - protein, 11 aa, Homo sapiens
KLGINDIEGQR

SEQ ID NO: 26814 - protein, 11 aa, Homo sapiens
KLGINDIEGQR

SEQ ID NO: 26815 - protein, 12 aa, Homo sapiens
DFTDEKEGPITK

SEQ ID NO: 26816 - protein, 12 aa, Homo sapiens
DFTDEKEGPITK

SEQ ID NO: 26817 - protein, 12 aa, Homo sapiens
DFTDEKEGPITK

SEQ ID NO: 26818 - protein, 11 aa, Homo sapiens
DVHLSKEQESR

SEQ ID NO: 26819 - protein, 11 aa, Homo sapiens
DVHLSKEQESR

SEQ ID NO: 26820 - protein, 11 aa, Homo sapiens
DVHLSKEQESR

SEQ ID NO: 26821 - protein, 11 aa, Homo sapiens
DVHLSKEQESR

SEQ ID NO: 26822 - protein, 6 aa, Homo sapiens
EKLYLR

SEQ ID NO: 26823 - protein, 4 aa, Homo sapiens
KVGR

SEQ ID NO: 26824 - protein, 4 aa, Homo sapiens
KVGR

SEQ ID NO: 26825 - protein, 4 aa, Homo sapiens
KVGR

SEQ ID NO: 26826 - protein, 4 aa, Homo sapiens
KVGR

SEQ ID NO: 26827 - protein, 4 aa, Homo sapiens
KVGR

SEQ ID NO: 26828 - protein, 4 aa, Homo sapiens
KVGR

SEQ ID NO: 26829 - protein, 10 aa, Homo sapiens
KRMEIQEAIK

SEQ ID NO: 26830 - protein, 5 aa, Homo sapiens
TKVER

SEQ ID NO: 26831 - protein, 11 aa, Homo sapiens
DVHLSKEQESR

SEQ ID NO: 26832 - protein, 11 aa, Homo sapiens
DVHLSKEQESR

SEQ ID NO: 26833 - protein, 11 aa, Homo sapiens
DVHLSKEQESR

SEQ ID NO: 26834 - protein, 7 aa, Homo sapiens
KASANAR

SEQ ID NO: 26835 - protein, 9 aa, Homo sapiens
SKDKAATPR

SEQ ID NO: 26836 - protein, 6 aa, Homo sapiens
GSLYKR

SEQ ID NO: 26837 - protein, 6 aa, Homo sapiens
GSLYKR

SEQ ID NO: 26838 - protein, 10 aa, Homo sapiens
ENSPEKFALK

SEQ ID NO: 26839 - protein, 4 aa, Homo sapiens
KVGR

SEQ ID NO: 26840 - protein, 5 aa, Homo sapiens
IEKER

SEQ ID NO: 26841 - protein, 7 aa, Homo sapiens
KVEEAAK

SEQ ID NO: 26842 - protein, 11 aa, Homo sapiens
DPKGYVQDLLR

SEQ ID NO: 26843 - protein, 11 aa, Homo sapiens
DPKGYVQDLLR

SEQ ID NO: 26844 - protein, 11 aa, Homo sapiens
DPKGYVQDLLR

SEQ ID NO: 26845 - protein, 11 aa, Homo sapiens
DPKGYVQDLLR

SEQ ID NO: 26846 - protein, 15 aa, Homo sapiens
VASAAAKSALEEFSK

SEQ ID NO: 26847 - protein, 15 aa, Homo sapiens
VASAAAKSALEEFSK

SEQ ID NO: 26848 - protein, 15 aa, Homo sapiens
VASAAAKSALEEFSK

SEQ ID NO: 26849 - protein, 15 aa, Homo sapiens
VASAAAKSALEEFSK

SEQ ID NO: 26850 - protein, 15 aa, Homo sapiens
VASAAAKSALEEFSK

SEQ ID NO: 26851 - protein, 15 aa, Homo sapiens
VASAAAKSALEEFSK

SEQ ID NO: 26852 - protein, 12 aa, Homo sapiens
KLEAELLQIEER

SEQ ID NO: 26853 - protein, 14 aa, Homo sapiens
LLEDSALSKYDATK

SEQ ID NO: 26854 - protein, 7 aa, Homo sapiens
RIEKERM

SEQ ID NO: 26855 - protein, 16 aa, Homo sapiens
RGRPPAEKLSPNPPKL

SEQ ID NO: 26856 - protein, 16 aa, Homo sapiens
RGRPPAEKLSPNPPKL

SEQ ID NO: 26857 - protein, 16 aa, Homo sapiens
RGRPPAEKLSPNPPKL

SEQ ID NO: 26858 - protein, 7 aa, Homo sapiens
RIEKERM

SEQ ID NO: 26859 - protein, 28 aa, Homo sapiens
RLTALLLPPDPIVINHVISVDPSDQKKT

SEQ ID NO: 26860 - protein, 19 aa, Homo sapiens
KIPAVGGKELDLHGLYTRV

SEQ ID NO: 26861 - protein, 19 aa, Homo sapiens
KIPAVGGKELDLHGLYTRV

SEQ ID NO: 26862 - protein, 19 aa, Homo sapiens
KIPAVGGKELDLHGLYTRV

SEQ ID NO: 26863 - protein, 18 aa, Homo sapiens
KSSTKQPTVGGTSSTPRA

SEQ ID NO: 26864 - protein, 18 aa, Homo sapiens
KSSTKQPTVGGTSSTPRA

SEQ ID NO: 26865 - protein, 18 aa, Homo sapiens
KSSTKQPTVGGTSSTPRA

SEQ ID NO: 26866 - protein, 18 aa, Homo sapiens
KSSTKQPTVGGTSSTPRA

SEQ ID NO: 26867 - protein, 14 aa, Homo sapiens
RDFTDEKEGPITKH

SEQ ID NO: 26868 - protein, 14 aa, Homo sapiens
RDFTDEKEGPITKH

SEQ ID NO: 26869 - protein, 14 aa, Homo sapiens
RDFTDEKEGPITKH

SEQ ID NO: 26870 - protein, 13 aa, Homo sapiens
RKIEVMENPSCRR

SEQ ID NO: 26871 - protein, 13 aa, Homo sapiens
RKIEVMENPSCRR

SEQ ID NO: 26872 - protein, 13 aa, Homo sapiens
RKIEVMENPSCRR

SEQ ID NO: 26873 - protein, 9 aa, Homo sapiens
RYLEKYEKV

SEQ ID NO: 26874 - protein, 43 aa, Homo sapiens; identical to SEQ ID NO: 26283

SEQ ID NO: 26875 - protein, 30 aa, Homo sapiens; identical to SEQ ID NO: 22385

SEQ ID NO: 26876 - protein, 30 aa, Homo sapiens; identical to SEQ ID NO: 22385

SEQ ID NO: 26877 - protein, 10 aa, Homo sapiens
KFKSNNLERE

SEQ ID NO: 26878 - protein, 10 aa, Homo sapiens
KFKSNNLERE

SEQ ID NO: 26879 - protein, 15 aa, Homo sapiens
KSDGDPIVDPEKEKE

SEQ ID NO: 26880 - protein, 15 aa, Homo sapiens
KSDGDPIVDPEKEKE

SEQ ID NO: 26881 - protein, 15 aa, Homo sapiens
KSDGDPIVDPEKEKE

SEQ ID NO: 26882 - protein, 15 aa, Homo sapiens
KSDGDPIVDPEKEKE

SEQ ID NO: 26883 - protein, 21 aa, Homo sapiens
REGGGAIEEEAKEKTSEAPKK

SEQ ID NO: 26884 - protein, 10 aa, Homo sapiens
KEKTSEAPKK

SEQ ID NO: 26885 - protein, 10 aa, Homo sapiens
KEKTSEAPKK

SEQ ID NO: 26886 - protein, 12 aa, Homo sapiens
KEGDSEKESEKS

SEQ ID NO: 26887 - protein, 12 aa, Homo sapiens
KEGDSEKESEKS

SEQ ID NO: 26888 - protein, 10 aa, Homo sapiens
KEKTSEAPKK

SEQ ID NO: 26889 - protein, 10 aa, Homo sapiens
KEKTSEAPKK

SEQ ID NO: 26890 - protein, 21 aa, Homo sapiens
REGGGAIEEEAKEKTSEAPKK

SEQ ID NO: 26891 - protein, 21 aa, Homo sapiens
REGGGAIEEEAKEKTSEAPKK

SEQ ID NO: 26892 - protein, 21 aa, Homo sapiens
REGGGAIEEEAKEKTSEAPKK

SEQ ID NO: 26893 - protein, 21 aa, Homo sapiens
REGGGAIEEEAKEKTSEAPKK

SEQ ID NO: 26894 - protein, 10 aa, Homo sapiens
KEKTSEAPKK

SEQ ID NO: 26895 - protein, 10 aa, Homo sapiens
KEKTSEAPKK

SEQ ID NO: 26896 - protein, 10 aa, Homo sapiens
KEKTSEAPKK

SEQ ID NO: 26897 - protein, 10 aa, Homo sapiens
KEKTSEAPKK

SEQ ID NO: 26898 - protein, 10 aa, Homo sapiens
KEKTSEAPKK

SEQ ID NO: 26899 - protein, 10 aa, Homo sapiens
KEKTSEAPKK

SEQ ID NO: 26900 - protein, 19 aa, Homo sapiens
KEGQEEVLKEVVESEGERK

SEQ ID NO: 26901 - protein, 19 aa, Homo sapiens
KEGQEEVLKEVVESEGERK

SEQ ID NO: 26902 - protein, 20 aa, Homo sapiens
KISAKTLTDEVNSPDSDRRD

SEQ ID NO: 26903 - protein, 20 aa, Homo sapiens
KISAKTLTDEVNSPDSDRRD

SEQ ID NO: 26904 - protein, 20 aa, Homo sapiens
KISAKTLTDEVNSPDSDRRD

SEQ ID NO: 26905 - protein, 20 aa, Homo sapiens
KISAKTLTDEVNSPDSDRRD

SEQ ID NO: 26906 - protein, 20 aa, Homo sapiens
KISAKTLTDEVNSPDSDRRD

SEQ ID NO: 26907 - protein, 14 aa, Homo sapiens
KEKPTDMQNFGLRT

SEQ ID NO: 26908 - protein, 15 aa, Homo sapiens
REGGGAIEEEAKEKT

SEQ ID NO: 26909 - protein, 15 aa, Homo sapiens
REGGGAIEEEAKEKT

SEQ ID NO: 26910 - protein, 15 aa, Homo sapiens
REGGGAIEEEAKEKT

SEQ ID NO: 26911 - protein, 15 aa, Homo sapiens
REGGGAIEEEAKEKT

SEQ ID NO: 26912 - protein, 21 aa, Homo sapiens
REGGGAIEEEAKEKTSEAPKK

SEQ ID NO: 26913 - protein, 15 aa, Homo sapiens
REGGGAIEEEAKEKT

SEQ ID NO: 26914 - protein, 15 aa, Homo sapiens
REGGGAIEEEAKEKT

SEQ ID NO: 26915 - protein, 21 aa, Homo sapiens
REGGGAIEEEAKEKTSEAPKK

SEQ ID NO: 26916 - protein, 15 aa, Homo sapiens
REGGGAIEEEAKEKT

SEQ ID NO: 26917 - protein, 15 aa, Homo sapiens
REGGGAIEEEAKEKT

SEQ ID NO: 26918 - protein, 38 aa, Homo sapiens; identical to SEQ ID NO: 6132

SEQ ID NO: 26919 - protein, 38 aa, Homo sapiens; identical to SEQ ID NO: 6132

SEQ ID NO: 26920 - protein, 38 aa, Homo sapiens; identical to SEQ ID NO: 6132

SEQ ID NO: 26921 - protein, 38 aa, Homo sapiens; identical to SEQ ID NO: 6132

SEQ ID NO: 26922 - protein, 38 aa, Homo sapiens; identical to SEQ ID NO: 6132

SEQ ID NO: 26923 - protein, 38 aa, Homo sapiens; identical to SEQ ID NO: 6132

SEQ ID NO: 26924 - protein, 28 aa, Homo sapiens
KVTGKADPAFGLESSGIAGTTSDEPERI

SEQ ID NO: 26925 - protein, 28 aa, Homo sapiens
KVTGKADPAFGLESSGIAGTTSDEPERI

SEQ ID NO: 26926 - protein, 19 aa, Homo sapiens
KEGQEEVLKEVVESEGERK

SEQ ID NO: 26927 - protein, 12 aa, Homo sapiens
KAKHLAAVEERK

SEQ ID NO: 26928 - protein, 12 aa, Homo sapiens
KAKHLAAVEERK

SEQ ID NO: 26929 - protein, 12 aa, Homo sapiens
KAKHLAAVEERK

SEQ ID NO: 26930 - protein, 9 aa, Homo sapiens
RKVEEAAKV

SEQ ID NO: 26931 - protein, 9 aa, Homo sapiens
RKVEEAAKV

SEQ ID NO: 26932 - protein, 15 aa, Homo sapiens
RVEGQATDEKKEPKE

SEQ ID NO: 26933 - protein, 18 aa, Homo sapiens
KSDGDPIVDPEKEKEPKE

SEQ ID NO: 26934 - protein, 18 aa, Homo sapiens
KSDGDPIVDPEKEKEPKE

SEQ ID NO: 26935 - protein, 18 aa, Homo sapiens
KSDGDPIVDPEKEKEPKE

SEQ ID NO: 26936 - protein, 17 aa, Homo sapiens
KESEKSDGDPIVDPEKE

SEQ ID NO: 26937 - protein, 17 aa, Homo sapiens
KESEKSDGDPIVDPEKE

SEQ ID NO: 26938 - protein, 17 aa, Homo sapiens
KESEKSDGDPIVDPEKE

SEQ ID NO: 26939 - protein, 8 aa, Homo sapiens
RKTKVERD

SEQ ID NO: 26940 - protein, 8 aa, Homo sapiens
RKTKVERD

SEQ ID NO: 26941 - protein, 8 aa, Homo sapiens
RKTKVERD

SEQ ID NO: 26942 - protein, 8 aa, Homo sapiens
RKTKVERD

SEQ ID NO: 26943 - protein, 19 aa, Homo sapiens
KEGQEEVLKEVVESEGERK

SEQ ID NO: 26944 - protein, 8 aa, Homo sapiens
RKTKVERD

SEQ ID NO: 26945 - protein, 8 aa, Homo sapiens
RKTKVERD

SEQ ID NO: 26946 - protein, 8 aa, Homo sapiens
RKTKVERD

SEQ ID NO: 26947 - protein, 8 aa, Homo sapiens
RKTKVERD

SEQ ID NO: 26948 - protein, 19 aa, Homo sapiens
KEGQEEVLKEVVESEGERK

SEQ ID NO: 26949 - protein, 19 aa, Homo sapiens
KEGQEEVLKEVVESEGERK

SEQ ID NO: 26950 - protein, 19 aa, Homo sapiens
KEGQEEVLKEVVESEGERK

SEQ ID NO: 26951 - protein, 19 aa, Homo sapiens
KEGQEEVLKEVVESEGERK

SEQ ID NO: 26952 - protein, 19 aa, Homo sapiens
KEGQEEVLKEVVESEGERK

SEQ ID NO: 26953 - protein, 19 aa, Homo sapiens
KEGQEEVLKEVVESEGERK

SEQ ID NO: 26954 - protein, 19 aa, Homo sapiens
KEGQEEVLKEVVESEGERK

SEQ ID NO: 26955 - protein, 19 aa, Homo sapiens
KEGQEEVLKEVVESEGERK

SEQ ID NO: 26956 - protein, 19 aa, Homo sapiens
KEGQEEVLKEVVESEGERK

SEQ ID NO: 26957 - protein, 19 aa, Homo sapiens
KEGQEEVLKEVVESEGERK

SEQ ID NO: 26958 - protein, 19 aa, Homo sapiens
KEGQEEVLKEVVESEGERK

SEQ ID NO: 26959 - protein, 19 aa, Homo sapiens
KEGQEEVLKEVVESEGERK

SEQ ID NO: 26960 - protein, 19 aa, Homo sapiens
KEGQEEVLKEVVESEGERK

SEQ ID NO: 26961 - protein, 19 aa, Homo sapiens
KEGQEEVLKEVVESEGERK

SEQ ID NO: 26962 - protein, 19 aa, Homo sapiens
KEGQEEVLKEVVESEGERK

SEQ ID NO: 26963 - protein, 19 aa, Homo sapiens
KEGQEEVLKEVVESEGERK

SEQ ID NO: 26964 - protein, 19 aa, Homo sapiens
KEGQEEVLKEVVESEGERK

SEQ ID NO: 26965 - protein, 9 aa, Homo sapiens
RKVEEAAKV

SEQ ID NO: 26966 - protein, 17 aa, Homo sapiens
KMKEEVPTALVEAHVRK

SEQ ID NO: 26967 - protein, 17 aa, Homo sapiens
KMKEEVPTALVEAHVRK

SEQ ID NO: 26968 - protein, 8 aa, Homo sapiens
RKTKVERD

SEQ ID NO: 26969 - protein, 7 aa, Homo sapiens
KTKVERD

SEQ ID NO: 26970 - protein, 17 aa, Homo sapiens
KMKEEVPTALVEAHVRK

SEQ ID NO: 26971 - protein, 12 aa, Homo sapiens
KAKHLAAVEERK

SEQ ID NO: 26972 - protein, 17 aa, Homo sapiens
KMKEEVPTALVEAHVRK

SEQ ID NO: 26973 - protein, 17 aa, Homo sapiens
KMKEEVPTALVEAHVRK

SEQ ID NO: 26974 - protein, 17 aa, Homo sapiens
KMKEEVPTALVEAHVRK

SEQ ID NO: 26975 - protein, 12 aa, Homo sapiens
KAKHLAAVEERK

SEQ ID NO: 26976 - protein, 12 aa, Homo sapiens
KAKHLAAVEERK

SEQ ID NO: 26977 - protein, 12 aa, Homo sapiens
KAKHLAAVEERK

SEQ ID NO: 26978 - protein, 12 aa, Homo sapiens
KAKHLAAVEERK

SEQ ID NO: 26979 - protein, 12 aa, Homo sapiens
KAKHLAAVEERK

SEQ ID NO: 26980 - protein, 12 aa, Homo sapiens
KAKHLAAVEERK

SEQ ID NO: 26981 - protein, 17 aa, Homo sapiens
KMKEEVPTALVEAHVRK

SEQ ID NO: 26982 - protein, 17 aa, Homo sapiens
KMKEEVPTALVEAHVRK

SEQ ID NO: 26983 - protein, 12 aa, Homo sapiens
KAKHLAAVEERK

SEQ ID NO: 26984 - protein, 17 aa, Homo sapiens
KMKEEVPTALVEAHVRK

SEQ ID NO: 26985 - protein, 17 aa, Homo sapiens
RVASAAAKSALEEFSKM

SEQ ID NO: 26986 - protein, 17 aa, Homo sapiens
RVASAAAKSALEEFSKM

SEQ ID NO: 26987 - protein, 17 aa, Homo sapiens
RVASAAAKSALEEFSKM

SEQ ID NO: 26988 - protein, 17 aa, Homo sapiens
RVASAAAKSALEEFSKM

SEQ ID NO: 26989 - protein, 17 aa, Homo sapiens
RVASAAAKSALEEFSKM

SEQ ID NO: 26990 - protein, 17 aa, Homo sapiens
RVASAAAKSALEEFSKM

SEQ ID NO: 26991 - protein, 17 aa, Homo sapiens
RVASAAAKSALEEFSKM

SEQ ID NO: 26992 - protein, 17 aa, Homo sapiens
RVASAAAKSALEEFSKM

SEQ ID NO: 26993 - protein, 17 aa, Homo sapiens
RVASAAAKSALEEFSKM

SEQ ID NO: 26994 - protein, 17 aa, Homo sapiens
RVASAAAKSALEEFSKM

SEQ ID NO: 26995 - protein, 17 aa, Homo sapiens
RVASAAAKSALEEFSKM

SEQ ID NO: 26996 - protein, 17 aa, Homo sapiens
RVASAAAKSALEEFSKM

SEQ ID NO: 26997 - protein, 17 aa, Homo sapiens
RVASAAAKSALEEFSKM

SEQ ID NO: 26998 - protein, 17 aa, Homo sapiens
RVASAAAKSALEEFSKM

SEQ ID NO: 26999 - protein, 17 aa, Homo sapiens
RVASAAAKSALEEFSKM

SEQ ID NO: 27000 - protein, 17 aa, Homo sapiens
RVASAAAKSALEEFSKM

SEQ ID NO: 27001 - protein, 17 aa, Homo sapiens
RVASAAAKSALEEFSKM

SEQ ID NO: 27002 - protein, 12 aa, Homo sapiens
KAKHLAAVEERK

SEQ ID NO: 27003 - protein, 17 aa, Homo sapiens
RVASAAAKSALEEFSKM

SEQ ID NO: 27004 - protein, 17 aa, Homo sapiens
RVASAAAKSALEEFSKM

SEQ ID NO: 27005 - protein, 17 aa, Homo sapiens
RVASAAAKSALEEFSKM

SEQ ID NO: 27006 - protein, 17 aa, Homo sapiens
RVASAAAKSALEEFSKM

SEQ ID NO: 27007 - protein, 12 aa, Homo sapiens
KAKHLAAVEERK

SEQ ID NO: 27008 - protein, 15 aa, Homo sapiens
RVEGQATDEKKEPKE

SEQ ID NO: 27009 - protein, 22 aa, Homo sapiens
RIEESGNDEARVEGQATDEKKE

SEQ ID NO: 27010 - protein, 12 aa, Homo sapiens
RVEGQATDEKKE

SEQ ID NO: 27011 - protein, 22 aa, Homo sapiens
RIEESGNDEARVEGQATDEKKE

SEQ ID NO: 27012 - protein, 12 aa, Homo sapiens
RVEGQATDEKKE

SEQ ID NO: 27013 - protein, 8 aa, Homo sapiens
KEPKEPRE

SEQ ID NO: 27014 - protein, 12 aa, Homo sapiens
RVEGQATDEKKE

SEQ ID NO: 27015 - protein, 8 aa, Homo sapiens
KEPKEPRE

SEQ ID NO: 27016 - protein, 8 aa, Homo sapiens
KEPKEPRE

SEQ ID NO: 27017 - protein, 8 aa, Homo sapiens
KEPKEPRE

SEQ ID NO: 27018 - protein, 8 aa, Homo sapiens
KEPKEPRE

SEQ ID NO: 27019 - protein, 8 aa, Homo sapiens
KEPKEPRE

SEQ ID NO: 27020 - protein, 8 aa, Homo sapiens
KEPKEPRE

SEQ ID NO: 27021 - protein, 12 aa, Homo sapiens
RVEGQATDEKKE

SEQ ID NO: 27022 - protein, 8 aa, Homo sapiens
KEPKEPRE

SEQ ID NO: 27023 - protein, 12 aa, Homo sapiens
RVEGQATDEKKE

SEQ ID NO: 27024 - protein, 8 aa, Homo sapiens
KEPKEPRE

SEQ ID NO: 27025 - protein, 12 aa, Homo sapiens
RVEGQATDEKKE

SEQ ID NO: 27026 - protein, 13 aa, Homo sapiens
RKVEEAAKVTGKA

SEQ ID NO: 27027 - protein, 11 aa, Homo sapiens
KSKAAASATRE

SEQ ID NO: 27028 - protein, 11 aa, Homo sapiens
KSKAAASATRE

SEQ ID NO: 27029 - protein, 38 aa, Homo sapiens; identical to SEQ ID NO: 6132

SEQ ID NO: 27030 - protein, 38 aa, Homo sapiens; identical to SEQ ID NO: 6132

SEQ ID NO: 27031 - protein, 15 aa, Homo sapiens
KDALVLHKVLLETRR

SEQ ID NO: 27032 - protein, 8 aa, Homo sapiens
KNYTDKRG

SEQ ID NO: 27033 - protein, 15 aa, Homo sapiens
KDALVLHKVLLETRR

SEQ ID NO: 27034 - protein, 21 aa, Homo sapiens
REAEKSEDSSGAAGLSGLHRT

SEQ ID NO: 27035 - protein, 9 aa, Homo sapiens
RKNVENNRY

SEQ ID NO: 27036 - protein, 9 aa, Homo sapiens
RKNVENNRY

SEQ ID NO: 27037 - protein, 9 aa, Homo sapiens
RKNVENNRY

SEQ ID NO: 27038 - protein, 9 aa, Homo sapiens
RKNVENNRY

SEQ ID NO: 27039 - protein, 9 aa, Homo sapiens
RKNVENNRY

SEQ ID NO: 27040 - protein, 26 aa, Homo sapiens
RVASVFANADKGDDEKNTDNSEDSRA

SEQ ID NO: 27041 - protein, 26 aa, Homo sapiens
RVASVFANADKGDDEKNTDNSEDSRA

SEQ ID NO: 27042 - protein, 26 aa, Homo sapiens
RVASVFANADKGDDEKNTDNSEDSRA

SEQ ID NO: 27043 - protein, 17 aa, Homo sapiens
RVASVFANADKGDDEKN

SEQ ID NO: 27044 - protein, 17 aa, Homo sapiens
RVASVFANADKGDDEKN

SEQ ID NO: 27045 - protein, 26 aa, Homo sapiens
RVASVFANADKGDDEKNTDNSEDSRA

SEQ ID NO: 27046 - protein, 26 aa, Homo sapiens
RVASVFANADKGDDEKNTDNSEDSRA

SEQ ID NO: 27047 - protein, 17 aa, Homo sapiens
RVASVFANADKGDDEKN

SEQ ID NO: 27048 - protein, 26 aa, Homo sapiens
RVASVFANADKGDDEKNTDNSEDSRA

SEQ ID NO: 27049 - protein, 17 aa, Homo sapiens
RVASVFANADKGDDEKN

SEQ ID NO: 27050 - protein, 17 aa, Homo sapiens
RVASVFANADKGDDEKN

SEQ ID NO: 27051 - protein, 26 aa, Homo sapiens
RVASVFANADKGDDEKNTDNSEDSRA

SEQ ID NO: 27052 - protein, 17 aa, Homo sapiens
RVASVFANADKGDDEKN

SEQ ID NO: 27053 - protein, 26 aa, Homo sapiens
RVASVFANADKGDDEKNTDNSEDSRA

SEQ ID NO: 27054 - protein, 26 aa, Homo sapiens
RVASVFANADKGDDEKNTDNSEDSRA

SEQ ID NO: 27055 - protein, 26 aa, Homo sapiens
RVASVFANADKGDDEKNTDNSEDSRA

SEQ ID NO: 27056 - protein, 26 aa, Homo sapiens
RVASVFANADKGDDEKNTDNSEDSRA

SEQ ID NO: 27057 - protein, 24 aa, Homo sapiens
KVQYPDYYAIIKEPIDLKTIAQRI

SEQ ID NO: 27058 - protein, 13 aa, Homo sapiens
KEPIDLKTIAQRI

SEQ ID NO: 27059 - protein, 13 aa, Homo sapiens
KEPIDLKTIAQRI

SEQ ID NO: 27060 - protein, 13 aa, Homo sapiens
KEPIDLKTIAQRI

SEQ ID NO: 27061 - protein, 13 aa, Homo sapiens
KEPIDLKTIAQRI

SEQ ID NO: 27062 - protein, 13 aa, Homo sapiens
KEPIDLKTIAQRI

SEQ ID NO: 27063 - protein, 14 aa, Homo sapiens
RLISELFQKLPSKV

SEQ ID NO: 27064 - protein, 24 aa, Homo sapiens
KVQYPDYYAIIKEPIDLKTIAQRI

SEQ ID NO: 27065 - protein, 24 aa, Homo sapiens
KVQYPDYYAIIKEPIDLKTIAQRI

SEQ ID NO: 27066 - protein, 14 aa, Homo sapiens
RLISELFQKLPSKV

SEQ ID NO: 27067 - protein, 14 aa, Homo sapiens
RLISELFQKLPSKV

SEQ ID NO: 27068 - protein, 24 aa, Homo sapiens
KVQYPDYYAIIKEPIDLKTIAQRI

SEQ ID NO: 27069 - protein, 14 aa, Homo sapiens
RLISELFQKLPSKV

SEQ ID NO: 27070 - protein, 14 aa, Homo sapiens
RLISELFQKLPSKV

SEQ ID NO: 27071 - protein, 14 aa, Homo sapiens
RLISELFQKLPSKV

SEQ ID NO: 27072 - protein, 14 aa, Homo sapiens
RLISELFQKLPSKV

SEQ ID NO: 27073 - protein, 14 aa, Homo sapiens
RLISELFQKLPSKV

SEQ ID NO: 27074 - protein, 13 aa, Homo sapiens
KEPIDLKTIAQRI

SEQ ID NO: 27075 - protein, 24 aa, Homo sapiens
KVQYPDYYAIIKEPIDLKTIAQRI

SEQ ID NO: 27076 - protein, 24 aa, Homo sapiens
KVQYPDYYAIIKEPIDLKTIAQRI

SEQ ID NO: 27077 - protein, 19 aa, Homo sapiens
RAVIKAQHPDYSFGELSRL

SEQ ID NO: 27078 - protein, 18 aa, Homo sapiens
KVGDCVFIKSHGLVRPRV

SEQ ID NO: 27079 - protein, 18 aa, Homo sapiens
KVGDCVFIKSHGLVRPRV

SEQ ID NO: 27080 - protein, 18 aa, Homo sapiens
KVGDCVFIKSHGLVRPRV

SEQ ID NO: 27081 - protein, 26 aa, Homo sapiens
RVASVFANADKGDDEKNTDNSEDSRA

SEQ ID NO: 27082 - protein, 26 aa, Homo sapiens
RVASVFANADKGDDEKNTDNSEDSRA

SEQ ID NO: 27083 - protein, 26 aa, Homo sapiens
RVASVFANADKGDDEKNTDNSEDSRA

SEQ ID NO: 27084 - protein, 26 aa, Homo sapiens
RVASVFANADKGDDEKNTDNSEDSRA

SEQ ID NO: 27085 - protein, 17 aa, Homo sapiens
RLTGPSHSKGSLGEERN

SEQ ID NO: 27086 - protein, 13 aa, Homo sapiens
RDVHLSKEQESRL

SEQ ID NO: 27087 - protein, 10 aa, Homo sapiens
RNPTSKYYRN

SEQ ID NO: 27088 - protein, 10 aa, Homo sapiens
RNPTSKYYRN

SEQ ID NO: 27089 - protein, 13 aa, Homo sapiens
RYNVPNSAIYKRV

SEQ ID NO: 27090 - protein, 10 aa, Homo sapiens
RNPTSKYYRN

SEQ ID NO: 27091 - protein, 10 aa, Homo sapiens
RNPTSKYYRN

SEQ ID NO: 27092 - protein, 25 aa, Homo sapiens
RRDDIEDGDSMISSATSDTGSAKRK

SEQ ID NO: 27093 - protein, 14 aa, Homo sapiens
RMKILFNVVLEARE

SEQ ID NO: 27094 - protein, 14 aa, Homo sapiens
RMKILFNVVLEARE

SEQ ID NO: 27095 - protein, 14 aa, Homo sapiens
RMKILFNVVLEARE

SEQ ID NO: 27096 - protein, 14 aa, Homo sapiens
RMKILFNVVLEARE

SEQ ID NO: 27097 - protein, 14 aa, Homo sapiens
RMKILFNVVLEARE

SEQ ID NO: 27098 - protein, 9 aa, Homo sapiens
RKNVENNRY

SEQ ID NO: 27099 - protein, 8 aa, Homo sapiens
RYSAKTKS

SEQ ID NO: 27100 - protein, 21 aa, Homo sapiens
REAEKSEDSSGAAGLSGLHRT

SEQ ID NO: 27101 - protein, 11 aa, Homo sapiens
KEIEEDKLKRE

SEQ ID NO: 27102 - protein, 12 aa, Homo sapiens
RAAKVAEQQERE

SEQ ID NO: 27103 - protein, 12 aa, Homo sapiens
RAAKVAEQQERE

SEQ ID NO: 27104 - protein, 12 aa, Homo sapiens
RAAKVAEQQERE

SEQ ID NO: 27105 - protein, 20 aa, Homo sapiens
KYPDYYQQIKMPISLQQIRT

SEQ ID NO: 27106 - protein, 21 aa, Homo sapiens
REAEKSEDSSGAAGLSGLHRT

SEQ ID NO: 27107 - protein, 21 aa, Homo sapiens
REAEKSEDSSGAAGLSGLHRT

SEQ ID NO: 27108 - protein, 21 aa, Homo sapiens
REAEKSEDSSGAAGLSGLHRT

SEQ ID NO: 27109 - protein, 17 aa, Homo sapiens
RKPIVPQKEPSPLLEKK

SEQ ID NO: 27110 - protein, 8 aa, Homo sapiens
KKKELARR

SEQ ID NO: 27111 - protein, 13 aa, Homo sapiens
RVLKLQQVMQAKK

SEQ ID NO: 27112 - protein, 8 aa, Homo sapiens
KKKELARR

SEQ ID NO: 27113 - protein, 13 aa, Homo sapiens
RVLKLQQVMQAKK

SEQ ID NO: 27114 - protein, 13 aa, Homo sapiens
KEPIDLKTIAQRI

SEQ ID NO: 27115 - protein, 13 aa, Homo sapiens
KEPIDLKTIAQRI

SEQ ID NO: 27116 - protein, 13 aa, Homo sapiens
KEPIDLKTIAQRI

SEQ ID NO: 27117 - protein, 13 aa, Homo sapiens
KEPIDLKTIAQRI

SEQ ID NO: 27118 - protein, 13 aa, Homo sapiens
KEPIDLKTIAQRI

SEQ ID NO: 27119 - protein, 13 aa, Homo sapiens
KEPIDLKTIAQRI

SEQ ID NO: 27120 - protein, 13 aa, Homo sapiens
KEPIDLKTIAQRI

SEQ ID NO: 27121 - protein, 13 aa, Homo sapiens
KEPIDLKTIAQRI

SEQ ID NO: 27122 - protein, 13 aa, Homo sapiens
KEPIDLKTIAQRI

SEQ ID NO: 27123 - protein, 12 aa, Homo sapiens
KHLHNDVEKERK

SEQ ID NO: 27124 - protein, 13 aa, Homo sapiens
KLPKEIEEDKLKR

SEQ ID NO: 27125 - protein, 13 aa, Homo sapiens
KLPKEIEEDKLKR

SEQ ID NO: 27126 - protein, 12 aa, Homo sapiens
KHLHNDVEKERK

SEQ ID NO: 27127 - protein, 8 aa, Homo sapiens
KKKELARR

SEQ ID NO: 27128 - protein, 7 aa, Homo sapiens
KKELARR

SEQ ID NO: 27129 - protein, 8 aa, Homo sapiens
KKKELARR

SEQ ID NO: 27130 - protein, 8 aa, Homo sapiens
KKKELARR

SEQ ID NO: 27131 - protein, 17 aa, Homo sapiens
KLNEVYEAVKNYTDKRG

SEQ ID NO: 27132 - protein, 10 aa, Homo sapiens
KEIEEDKLKR

SEQ ID NO: 27133 - protein, 11 aa, Homo sapiens
KEIEEDKLKRE

SEQ ID NO: 27134 - protein, 21 aa, Homo sapiens
REAEKSEDSSGAAGLSGLHRT

SEQ ID NO: 27135 - protein, 21 aa, Homo sapiens
REAEKSEDSSGAAGLSGLHRT

SEQ ID NO: 27136 - protein, 21 aa, Homo sapiens
REAEKSEDSSGAAGLSGLHRT

SEQ ID NO: 27137 - protein, 21 aa, Homo sapiens
REAEKSEDSSGAAGLSGLHRT

SEQ ID NO: 27138 - protein, 13 aa, Homo sapiens
RDVHLSKEQESRL

SEQ ID NO: 27139 - protein, 26 aa, Homo sapiens
RVASVFANADKGDDEKNTDNSEDSRA

SEQ ID NO: 27140 - protein, 26 aa, Homo sapiens
RVASVFANADKGDDEKNTDNSEDSRA

SEQ ID NO: 27141 - protein, 16 aa, Homo sapiens
KGDDEKNTDNSEDSRA

SEQ ID NO: 27142 - protein, 26 aa, Homo sapiens
RVASVFANADKGDDEKNTDNSEDSRA

SEQ ID NO: 27143 - protein, 26 aa, Homo sapiens
RVASVFANADKGDDEKNTDNSEDSRA

SEQ ID NO: 27144 - protein, 26 aa, Homo sapiens
RVASVFANADKGDDEKNTDNSEDSRA

SEQ ID NO: 27145 - protein, 12 aa, Homo sapiens
RAAKVAEQQERE

SEQ ID NO: 27146 - protein, 13 aa, Homo sapiens
RYNVPNSAIYKRV

SEQ ID NO: 27147 - protein, 13 aa, Homo sapiens
RYNVPNSAIYKRV

SEQ ID NO: 27148 - protein, 13 aa, Homo sapiens
RVLKLQQVMQAKK

SEQ ID NO: 27149 - protein, 13 aa, Homo sapiens
RVLKLQQVMQAKK

SEQ ID NO: 27150 - protein, 13 aa, Homo sapiens
RVLKLQQVMQAKK

SEQ ID NO: 27151 - protein, 13 aa, Homo sapiens
RVLKLQQVMQAKK

SEQ ID NO: 27152 - protein, 13 aa, Homo sapiens
RVLKLQQVMQAKK

SEQ ID NO: 27153 - protein, 13 aa, Homo sapiens
RVLKLQQVMQAKK

SEQ ID NO: 27154 - protein, 13 aa, Homo sapiens
RYNVPNSAIYKRV

SEQ ID NO: 27155 - protein, 13 aa, Homo sapiens
RVLKLQQVMQAKK

SEQ ID NO: 27156 - protein, 13 aa, Homo sapiens
RYNVPNSAIYKRV

SEQ ID NO: 27157 - protein, 13 aa, Homo sapiens
RYNVPNSAIYKRV

SEQ ID NO: 27158 - protein, 14 aa, Homo sapiens
KRYNVPNSAIYKRV

SEQ ID NO: 27159 - protein, 14 aa, Homo sapiens
KRYNVPNSAIYKRV

SEQ ID NO: 27160 - protein, 13 aa, Homo sapiens
RYNVPNSAIYKRV

SEQ ID NO: 27161 - protein, 13 aa, Homo sapiens
RVLKLQQVMQAKK

SEQ ID NO: 27162 - protein, 13 aa, Homo sapiens
RVLKLQQVMQAKK

SEQ ID NO: 27163 - protein, 13 aa, Homo sapiens
RYNVPNSAIYKRV

SEQ ID NO: 27164 - protein, 13 aa, Homo sapiens
RVLKLQQVMQAKK

SEQ ID NO: 27165 - protein, 13 aa, Homo sapiens
RVLKLQQVMQAKK

SEQ ID NO: 27166 - protein, 13 aa, Homo sapiens
RVLKLQQVMQAKK

SEQ ID NO: 27167 - protein, 13 aa, Homo sapiens
RYNVPNSAIYKRV

SEQ ID NO: 27168 - protein, 13 aa, Homo sapiens
RYNVPNSAIYKRV

SEQ ID NO: 27169 - protein, 13 aa, Homo sapiens
RVLKLQQVMQAKK

SEQ ID NO: 27170 - protein, 13 aa, Homo sapiens
RVLKLQQVMQAKK

SEQ ID NO: 27171 - protein, 17 aa, Homo sapiens
KLNEVYEAVKNYTDKRG

SEQ ID NO: 27172 - protein, 17 aa, Homo sapiens
RLTGPSHSKGSLGEERN

SEQ ID NO: 27173 - protein, 17 aa, Homo sapiens
RLTGPSHSKGSLGEERN

SEQ ID NO: 27174 - protein, 13 aa, Homo sapiens
RVLKLQQVMQAKK

SEQ ID NO: 27175 - protein, 17 aa, Homo sapiens
RLTGPSHSKGSLGEERN

SEQ ID NO: 27176 - protein, 17 aa, Homo sapiens
RLTGPSHSKGSLGEERN

SEQ ID NO: 27177 - protein, 17 aa, Homo sapiens
RLTGPSHSKGSLGEERN

SEQ ID NO: 27178 - protein, 17 aa, Homo sapiens
RLTGPSHSKGSLGEERN

SEQ ID NO: 27179 - protein, 17 aa, Homo sapiens
RLTGPSHSKGSLGEERN

SEQ ID NO: 27180 - protein, 10 aa, Homo sapiens
RNPTSKYYRN

SEQ ID NO: 27181 - protein, 17 aa, Homo sapiens
RLTGPSHSKGSLGEERN

SEQ ID NO: 27182 - protein, 17 aa, Homo sapiens
RLTGPSHSKGSLGEERN

SEQ ID NO: 27183 - protein, 17 aa, Homo sapiens
RLTGPSHSKGSLGEERN

SEQ ID NO: 27184 - protein, 17 aa, Homo sapiens
RLTGPSHSKGSLGEERN

SEQ ID NO: 27185 - protein, 17 aa, Homo sapiens
RLTGPSHSKGSLGEERN

SEQ ID NO: 27186 - protein, 17 aa, Homo sapiens
RLTGPSHSKGSLGEERN

SEQ ID NO: 27187 - protein, 19 aa, Homo sapiens
RAVIKAQHPDYSFGELSRL

SEQ ID NO: 27188 - protein, 19 aa, Homo sapiens
RAVIKAQHPDYSFGELSRL

SEQ ID NO: 27189 - protein, 19 aa, Homo sapiens
RAVIKAQHPDYSFGELSRL

SEQ ID NO: 27190 - protein, 19 aa, Homo sapiens
RAVIKAQHPDYSFGELSRL

SEQ ID NO: 27191 - protein, 19 aa, Homo sapiens
RAVIKAQHPDYSFGELSRL

SEQ ID NO: 27192 - protein, 19 aa, Homo sapiens
RAVIKAQHPDYSFGELSRL

SEQ ID NO: 27193 - protein, 19 aa, Homo sapiens
RAVIKAQHPDYSFGELSRL

SEQ ID NO: 27194 - protein, 19 aa, Homo sapiens
RAVIKAQHPDYSFGELSRL

SEQ ID NO: 27195 - protein, 19 aa, Homo sapiens
RAVIKAQHPDYSFGELSRL

SEQ ID NO: 27196 - protein, 19 aa, Homo sapiens
RAVIKAQHPDYSFGELSRL

SEQ ID NO: 27197 - protein, 19 aa, Homo sapiens
RAVIKAQHPDYSFGELSRL

SEQ ID NO: 27198 - protein, 19 aa, Homo sapiens
RAVIKAQHPDYSFGELSRL

SEQ ID NO: 27199 - protein, 19 aa, Homo sapiens
RAVIKAQHPDYSFGELSRL

SEQ ID NO: 27200 - protein, 19 aa, Homo sapiens
RAVIKAQHPDYSFGELSRL

SEQ ID NO: 27201 - protein, 13 aa, Homo sapiens
RELSQKTPPSMRL

SEQ ID NO: 27202 - protein, 13 aa, Homo sapiens
RELSQKTPPSMRL

SEQ ID NO: 27203 - protein, 13 aa, Homo sapiens
RELSQKTPPSMRL

SEQ ID NO: 27204 - protein, 11 aa, Homo sapiens
RKEKLPQVTRS

SEQ ID NO: 27205 - protein, 11 aa, Homo sapiens
RKEKLPQVTRS

SEQ ID NO: 27206 - protein, 11 aa, Homo sapiens
RKEKLPQVTRS

SEQ ID NO: 27207 - protein, 11 aa, Homo sapiens
RKEKLPQVTRS

SEQ ID NO: 27208 - protein, 11 aa, Homo sapiens
REGSPANWKRK

SEQ ID NO: 27209 - protein, 11 aa, Homo sapiens
REGSPANWKRK

SEQ ID NO: 27210 - protein, 11 aa, Homo sapiens
RKEKLPQVTRS

SEQ ID NO: 27211 - protein, 11 aa, Homo sapiens
RKEKLPQVTRS

SEQ ID NO: 27212 - protein, 11 aa, Homo sapiens
REGSPANWKRK

SEQ ID NO: 27213 - protein, 11 aa, Homo sapiens
RKEKLPQVTRS

SEQ ID NO: 27214 - protein, 18 aa, Homo sapiens
KGKQGGPTYYIDTNALRV

SEQ ID NO: 27215 - protein, 18 aa, Homo sapiens
KGKQGGPTYYIDTNALRV

SEQ ID NO: 27216 - protein, 15 aa, Homo sapiens
KQEYEEGGKQCVERK

SEQ ID NO: 27217 - protein, 15 aa, Homo sapiens
KQEYEEGGKQCVERK

SEQ ID NO: 27218 - protein, 15 aa, Homo sapiens
KQEYEEGGKQCVERK

SEQ ID NO: 27219 - protein, 22 aa, Homo sapiens
REKLTELMFEHYNIPAFFLCKT

SEQ ID NO: 27220 - protein, 15 aa, Homo sapiens
KQEYEEGGKQCVERK

SEQ ID NO: 27221 - protein, 22 aa, Homo sapiens
REKLTELMFEHYNIPAFFLCKT

SEQ ID NO: 27222 - protein, 22 aa, Homo sapiens
REKLTELMFEHYNIPAFFLCKT

SEQ ID NO: 27223 - protein, 22 aa, Homo sapiens
REKLTELMFEHYNIPAFFLCKT

SEQ ID NO: 27224 - protein, 15 aa, Homo sapiens
KQEYEEGGKQCVERK

SEQ ID NO: 27225 - protein, 22 aa, Homo sapiens
REKLTELMFEHYNIPAFFLCKT

SEQ ID NO: 27226 - protein, 22 aa, Homo sapiens
REKLTELMFEHYNIPAFFLCKT

SEQ ID NO: 27227 - protein, 22 aa, Homo sapiens
REKLTELMFEHYNIPAFFLCKT

SEQ ID NO: 27228 - protein, 22 aa, Homo sapiens
REKLTELMFEHYNIPAFFLCKT

SEQ ID NO: 27229 - protein, 12 aa, Homo sapiens
RLDGTTKAEDRG

SEQ ID NO: 27230 - protein, 13 aa, Homo sapiens
RKELPEYYELIRK

SEQ ID NO: 27231 - protein, 7 aa, Homo sapiens
KIKLGRK

SEQ ID NO: 27232 - protein, 10 aa, Homo sapiens
KYKLNVDQKV

SEQ ID NO: 27233 - protein, 10 aa, Homo sapiens
KYKLNVDQKV

SEQ ID NO: 27234 - protein, 7 aa, Homo sapiens
RIEKERM

SEQ ID NO: 27235 - protein, 7 aa, Homo sapiens
RIEKERM

SEQ ID NO: 27236 - protein, 7 aa, Homo sapiens
RIEKERM

SEQ ID NO: 27237 - protein, 7 aa, Homo sapiens
RLKGGRR

SEQ ID NO: 27238 - protein, 16 aa, Homo sapiens
KLTKAVATYHANTERE

SEQ ID NO: 27239 - protein, 16 aa, Homo sapiens
KLTKAVATYHANTERE

SEQ ID NO: 27240 - protein, 16 aa, Homo sapiens
KLTKAVATYHANTERE

SEQ ID NO: 27241 - protein, 13 aa, Homo sapiens
RKELPEYYELIRK

SEQ ID NO: 27242 - protein, 13 aa, Homo sapiens
RKELPEYYELIRK

SEQ ID NO: 27243 - protein, 13 aa, Homo sapiens
RKELPEYYELIRK

SEQ ID NO: 27244 - protein, 13 aa, Homo sapiens
RKELPEYYELIRK

SEQ ID NO: 27245 - protein, 12 aa, Homo sapiens
RLDGTTKAEDRG

SEQ ID NO: 27246 - protein, 13 aa, Homo sapiens
RKELPEYYELIRK

SEQ ID NO: 27247 - protein, 19 aa, Homo sapiens
RGRPPAEKLSPNPPNLTKK

SEQ ID NO: 27248 - protein, 19 aa, Homo sapiens
RGRPPAEKLSPNPPNLTKK

SEQ ID NO: 27249 - protein, 19 aa, Homo sapiens
RGRPPAEKLSPNPPNLTKK

SEQ ID NO: 27250 - protein, 19 aa, Homo sapiens
RGRPPAEKLSPNPPNLTKK

SEQ ID NO: 27251 - protein, 19 aa, Homo sapiens
RGRPPAEKLSPNPPNLTKK

SEQ ID NO: 27252 - protein, 19 aa, Homo sapiens
RGRPPAEKLSPNPPNLTKK

SEQ ID NO: 27253 - protein, 19 aa, Homo sapiens
RGRPPAEKLSPNPPNLTKK

SEQ ID NO: 27254 - protein, 19 aa, Homo sapiens
RGRPPAEKLSPNPPNLTKK

SEQ ID NO: 27255 - protein, 19 aa, Homo sapiens
RGRPPAEKLSPNPPNLTKK

SEQ ID NO: 27256 - protein, 8 aa, Homo sapiens
RKPVDFKK

SEQ ID NO: 27257 - protein, 7 aa, Homo sapiens
RNHKYRS

SEQ ID NO: 27258 - protein, 9 aa, Homo sapiens
RKPVDFKKI

SEQ ID NO: 27259 - protein, 9 aa, Homo sapiens
RIRNHKYRS

SEQ ID NO: 27260 - protein, 9 aa, Homo sapiens
RIRNHKYRS

SEQ ID NO: 27261 - protein, 8 aa, Homo sapiens
RKPVDFKK

SEQ ID NO: 27262 - protein, 8 aa, Homo sapiens
RILPKLRA

SEQ ID NO: 27263 - protein, 12 aa, Homo sapiens
RASGKFELLDRI

SEQ ID NO: 27264 - protein, 24 aa, Homo sapiens
RHIIENAKQDVDDEYGVSQALARG

SEQ ID NO: 27265 - protein, 24 aa, Homo sapiens
RHIIENAKQDVDDEYGVSQALARG

SEQ ID NO: 27266 - protein, 7 aa, Homo sapiens
RLKGGRR

SEQ ID NO: 27267 - protein, 7 aa, Homo sapiens
RLKGGRR

SEQ ID NO: 27268 - protein, 7 aa, Homo sapiens
RLKGGRR

SEQ ID NO: 27269 - protein, 7 aa, Homo sapiens
KKENERI

SEQ ID NO: 27270 - protein, 7 aa, Homo sapiens
KKENERI

SEQ ID NO: 27271 - protein, 7 aa, Homo sapiens
KKENERI

SEQ ID NO: 27272 - protein, 18 aa, Homo sapiens
RKRDSDAGSSTPTTSTRS

SEQ ID NO: 27273 - protein, 18 aa, Homo sapiens
RKRDSDAGSSTPTTSTRS

SEQ ID NO: 27274 - protein, 18 aa, Homo sapiens
RKRDSDAGSSTPTTSTRS

SEQ ID NO: 27275 - protein, 7 aa, Homo sapiens
KKENERI

SEQ ID NO: 27276 - protein, 17 aa, Homo sapiens
KAVATYHANTEREQKKE

SEQ ID NO: 27277 - protein, 7 aa, Homo sapiens
RIEKERM

SEQ ID NO: 27278 - protein, 7 aa, Homo sapiens
RIEKERM

SEQ ID NO: 27279 - protein, 10 aa, Homo sapiens
REQKKENERI

SEQ ID NO: 27280 - protein, 10 aa, Homo sapiens
REQKKENERI

SEQ ID NO: 27281 - protein, 7 aa, Homo sapiens
RIEKERM

SEQ ID NO: 27282 - protein, 10 aa, Homo sapiens
REQKKENERI

SEQ ID NO: 27283 - protein, 11 aa, Homo sapiens
KIKIIAPPERK

SEQ ID NO: 27284 - protein, 11 aa, Homo sapiens
KIKIIAPPERK

SEQ ID NO: 27285 - protein, 11 aa, Homo sapiens
KIKIIAPPERK

SEQ ID NO: 27286 - protein, 11 aa, Homo sapiens
KIKIIAPPERK

SEQ ID NO: 27287 - protein, 11 aa, Homo sapiens
KIKIIAPPERK

SEQ ID NO: 27288 - protein, 15 aa, Homo sapiens
KEITALAPSTMKIKI

SEQ ID NO: 27289 - protein, 15 aa, Homo sapiens
KEITALAPSTMKIKI

SEQ ID NO: 27290 - protein, 15 aa, Homo sapiens
KEITALAPSTMKIKI

SEQ ID NO: 27291 - protein, 15 aa, Homo sapiens
KEITALAPSTMKIKI

SEQ ID NO: 27292 - protein, 15 aa, Homo sapiens
KEITALAPSTMKIKI

SEQ ID NO: 27293 - protein, 5 aa, Homo sapiens
KKIRD

SEQ ID NO: 27294 - protein, 5 aa, Homo sapiens
KKIRD

SEQ ID NO: 27295 - protein, 5 aa, Homo sapiens
KKIRD

SEQ ID NO: 27296 - protein, 5 aa, Homo sapiens
KKIRD

SEQ ID NO: 27297 - protein, 9 aa, Homo sapiens
RKFSSFFKS

SEQ ID NO: 27298 - protein, 10 aa, Homo sapiens
KRKFSSFFKS

SEQ ID NO: 27299 - protein, 11 aa, Homo sapiens
RMKFSEIPQRL

SEQ ID NO: 27300 - protein, 21 aa, Homo sapiens
RKRPAPQQIQQVQQQAVQNRN

SEQ ID NO: 27301 - protein, 9 aa, Homo sapiens
RAKDDIKRV

SEQ ID NO: 27302 - protein, 9 aa, Homo sapiens
RAKDDIKRV

SEQ ID NO: 27303 - protein, 9 aa, Homo sapiens
RAKDDIKRV

SEQ ID NO: 27304 - protein, 9 aa, Homo sapiens
RAKDDIKRV

SEQ ID NO: 27305 - protein, 9 aa, Homo sapiens
RAKDDIKRV

SEQ ID NO: 27306 - protein, 17 aa, Homo sapiens
RKFLESTDSFNNELKRL

SEQ ID NO: 27307 - protein, 17 aa, Homo sapiens
RKFLESTDSFNNELKRL

SEQ ID NO: 27308 - protein, 17 aa, Homo sapiens
RKFLESTDSFNNELKRL

SEQ ID NO: 27309 - protein, 17 aa, Homo sapiens
RKFLESTDSFNNELKRL

SEQ ID NO: 27310 - protein, 16 aa, Homo sapiens
RKFLESTDSFNNELKR

SEQ ID NO: 27311 - protein, 16 aa, Homo sapiens
RKFLESTDSFNNELKR

SEQ ID NO: 27312 - protein, 16 aa, Homo sapiens
RKFLESTDSFNNELKR

SEQ ID NO: 27313 - protein, 17 aa, Homo sapiens
RKFLESTDSFNNELKRL

SEQ ID NO: 27314 - protein, 12 aa, Homo sapiens
REKEAAEQAERS

SEQ ID NO: 27315 - protein, 12 aa, Homo sapiens
REKEAAEQAERS

SEQ ID NO: 27316 - protein, 12 aa, Homo sapiens
REKEAAEQAERS

SEQ ID NO: 27317 - protein, 12 aa, Homo sapiens
REKEAAEQAERS

SEQ ID NO: 27318 - protein, 12 aa, Homo sapiens
REKEAAEQAERS

SEQ ID NO: 27319 - protein, 12 aa, Homo sapiens
REKEAAEQAERS

SEQ ID NO: 27320 - protein, 12 aa, Homo sapiens
REKEAAEQAERS

SEQ ID NO: 27321 - protein, 14 aa, Homo sapiens
RLCGLKVEVDMEKI

SEQ ID NO: 27322 - protein, 14 aa, Homo sapiens
RLCGLKVEVDMEKI

SEQ ID NO: 27323 - protein, 14 aa, Homo sapiens
RLCGLKVEVDMEKI

SEQ ID NO: 27324 - protein, 14 aa, Homo sapiens
RLCGLKVEVDMEKI

SEQ ID NO: 27325 - protein, 14 aa, Homo sapiens
RLCGLKVEVDMEKI

SEQ ID NO: 27326 - protein, 14 aa, Homo sapiens
RLCGLKVEVDMEKI

SEQ ID NO: 27327 - protein, 14 aa, Homo sapiens
RLCGLKVEVDMEKI

SEQ ID NO: 27328 - protein, 14 aa, Homo sapiens
RLCGLKVEVDMEKI

SEQ ID NO: 27329 - protein, 14 aa, Homo sapiens
RLCGLKVEVDMEKI

SEQ ID NO: 27330 - protein, 14 aa, Homo sapiens
RLCGLKVEVDMEKI

SEQ ID NO: 27331 - protein, 14 aa, Homo sapiens
RLCGLKVEVDMEKI

SEQ ID NO: 27332 - protein, 14 aa, Homo sapiens
RLCGLKVEVDMEKI

SEQ ID NO: 27333 - protein, 14 aa, Homo sapiens
RLCGLKVEVDMEKI

SEQ ID NO: 27334 - protein, 14 aa, Homo sapiens
RLCGLKVEVDMEKI

SEQ ID NO: 27335 - protein, 14 aa, Homo sapiens
RLCGLKVEVDMEKI

SEQ ID NO: 27336 - protein, 14 aa, Homo sapiens
RLCGLKVEVDMEKI

SEQ ID NO: 27337 - protein, 28 aa, Homo sapiens
KLAGLLQHPDPIVINHVISVDPNDQKKT

SEQ ID NO: 27338 - protein, 28 aa, Homo sapiens
KLAGLLQHPDPIVINHVISVDPNDQKKT

SEQ ID NO: 27339 - protein, 28 aa, Homo sapiens
KLAGLLQHPDPIVINHVISVDPNDQKKT

SEQ ID NO: 27340 - protein, 28 aa, Homo sapiens
KLAGLLQHPDPIVINHVISVDPNDQKKT

SEQ ID NO: 27341 - protein, 28 aa, Homo sapiens
KLAGLLQHPDPIVINHVISVDPNDQKKT

SEQ ID NO: 27342 - protein, 17 aa, Homo sapiens
RVASAAAKAALEEFSRV

SEQ ID NO: 27343 - protein, 17 aa, Homo sapiens
RVASAAAKAALEEFSRV

SEQ ID NO: 27344 - protein, 17 aa, Homo sapiens
RVASAAAKAALEEFSRV

SEQ ID NO: 27345 - protein, 17 aa, Homo sapiens
RVASAAAKAALEEFSRV

SEQ ID NO: 27346 - protein, 17 aa, Homo sapiens
RVASAAAKAALEEFSRV

SEQ ID NO: 27347 - protein, 17 aa, Homo sapiens
RVASAAAKAALEEFSRV

SEQ ID NO: 27348 - protein, 17 aa, Homo sapiens
RVASAAAKAALEEFSRV

SEQ ID NO: 27349 - protein, 17 aa, Homo sapiens
RVASAAAKAALEEFSRV

SEQ ID NO: 27350 - protein, 17 aa, Homo sapiens
RVASAAAKAALEEFSRV

SEQ ID NO: 27351 - protein, 17 aa, Homo sapiens
RVASAAAKAALEEFSRV

SEQ ID NO: 27352 - protein, 17 aa, Homo sapiens
RVASAAAKAALEEFSRV

SEQ ID NO: 27353 - protein, 17 aa, Homo sapiens
RVASAAAKAALEEFSRV

SEQ ID NO: 27354 - protein, 17 aa, Homo sapiens
RVASAAAKAALEEFSRV

SEQ ID NO: 27355 - protein, 17 aa, Homo sapiens
RVASAAAKAALEEFSRV

SEQ ID NO: 27356 - protein, 17 aa, Homo sapiens
RVASAAAKAALEEFSRV

SEQ ID NO: 27357 - protein, 17 aa, Homo sapiens
RVASAAAKAALEEFSRV

SEQ ID NO: 27358 - protein, 17 aa, Homo sapiens
RVASAAAKAALEEFSRV

SEQ ID NO: 27359 - protein, 17 aa, Homo sapiens
RVASAAAKAALEEFSRV

SEQ ID NO: 27360 - protein, 17 aa, Homo sapiens
RVASAAAKAALEEFSRV

SEQ ID NO: 27361 - protein, 17 aa, Homo sapiens
RVASAAAKAALEEFSRV

SEQ ID NO: 27362 - protein, 17 aa, Homo sapiens
RVASAAAKAALEEFSRV

SEQ ID NO: 27363 - protein, 17 aa, Homo sapiens
RVASAAAKAALEEFSRV

SEQ ID NO: 27364 - protein, 17 aa, Homo sapiens
RVASAAAKAALEEFSRV

SEQ ID NO: 27365 - protein, 17 aa, Homo sapiens
RVASAAAKAALEEFSRV

SEQ ID NO: 27366 - protein, 17 aa, Homo sapiens
RVASAAAKAALEEFSRV

SEQ ID NO: 27367 - protein, 17 aa, Homo sapiens
RVASAAAKAALEEFSRV

SEQ ID NO: 27368 - protein, 18 aa, Homo sapiens
RVREEVPLELVEAHVKKV

SEQ ID NO: 27369 - protein, 18 aa, Homo sapiens
RVREEVPLELVEAHVKKV

SEQ ID NO: 27370 - protein, 18 aa, Homo sapiens
RVREEVPLELVEAHVKKV

SEQ ID NO: 27371 - protein, 18 aa, Homo sapiens
RVREEVPLELVEAHVKKV

SEQ ID NO: 27372 - protein, 18 aa, Homo sapiens
RVREEVPLELVEAHVKKV

SEQ ID NO: 27373 - protein, 13 aa, Homo sapiens
RHQGTFTDEKSKA

SEQ ID NO: 27374 - protein, 12 aa, Homo sapiens
RISTKNEEPVRS

SEQ ID NO: 27375 - protein, 16 aa, Homo sapiens
RISTKNEEPVRSPERR

SEQ ID NO: 27376 - protein, 12 aa, Homo sapiens
RISTKNEEPVRS

SEQ ID NO: 27377 - protein, 13 aa, Homo sapiens
RALPEFFNGKNKS

SEQ ID NO: 27378 - protein, 11 aa, Homo sapiens
KGQASLYGKRR

SEQ ID NO: 27379 - protein, 15 aa, Homo sapiens
RSQKEEDEQEDLTKD

SEQ ID NO: 27380 - protein, 12 aa, Homo sapiens
KAKHLAAVEERK

SEQ ID NO: 27381 - protein, 12 aa, Homo sapiens
KAKHLAAVEERK

SEQ ID NO: 27382 - protein, 12 aa, Homo sapiens
KAKHLAAVEERK

SEQ ID NO: 27383 - protein, 12 aa, Homo sapiens
KAKHLAAVEERK

SEQ ID NO: 27384 - protein, 12 aa, Homo sapiens
KAKHLAAVEERK

SEQ ID NO: 27385 - protein, 12 aa, Homo sapiens
KAKHLAAVEERK

SEQ ID NO: 27386 - protein, 10 aa, Homo sapiens
KSKGASAGRE

SEQ ID NO: 27387 - protein, 9 aa, Homo sapiens
RESDTGKKK

SEQ ID NO: 27388 - protein, 14 aa, Homo sapiens
KEKPVDLQNFGLRT

SEQ ID NO: 27389 - protein, 14 aa, Homo sapiens
KEKPVDLQNFGLRT

SEQ ID NO: 27390 - protein, 14 aa, Homo sapiens
KEKPVDLQNFGLRT

SEQ ID NO: 27391 - protein, 20 aa, Homo sapiens
RSPQVPAAQQMLNFPEKNKE

SEQ ID NO: 27392 - protein, 20 aa, Homo sapiens
RSPQVPAAQQMLNFPEKNKE

SEQ ID NO: 27393 - protein, 36 aa, Homo sapiens; identical to SEQ ID NO: 6516

SEQ ID NO: 27394 - protein, 12 aa, Homo sapiens
KAKHLAAVEERK

SEQ ID NO: 27395 - protein, 12 aa, Homo sapiens
KAKHLAAVEERK

SEQ ID NO: 27396 - protein, 12 aa, Homo sapiens
KAKHLAAVEERK

SEQ ID NO: 27397 - protein, 16 aa, Homo sapiens
RISTKNEEPVRSPERR

SEQ ID NO: 27398 - protein, 16 aa, Homo sapiens
RISTKNEEPVRSPERR

SEQ ID NO: 27399 - protein, 16 aa, Homo sapiens
RISTKNEEPVRSPERR

SEQ ID NO: 27400 - protein, 16 aa, Homo sapiens
RISTKNEEPVRSPERR

SEQ ID NO: 27401 - protein, 12 aa, Homo sapiens
RISTKNEEPVRS

SEQ ID NO: 27402 - protein, 16 aa, Homo sapiens
RISTKNEEPVRSPERR

SEQ ID NO: 27403 - protein, 12 aa, Homo sapiens
RISTKNEEPVRS

SEQ ID NO: 27404 - protein, 6 aa, Homo sapiens
RKVGRR

SEQ ID NO: 27405 - protein, 22 aa, Homo sapiens
RTKVSSYPVALIPGQFQEYYKR

SEQ ID NO: 27406 - protein, 22 aa, Homo sapiens
RTKVSSYPVALIPGQFQEYYKR

SEQ ID NO: 27407 - protein, 23 aa, Homo sapiens
RTKVSSYPVALIPGQFQEYYKRY

SEQ ID NO: 27408 - protein, 10 aa, Homo sapiens
KYKVLPTERT

SEQ ID NO: 27409 - protein, 22 aa, Homo sapiens
RTKVSSYPVALIPGQFQEYYKR

SEQ ID NO: 27410 - protein, 23 aa, Homo sapiens
RTKVSSYPVALIPGQFQEYYKRY

SEQ ID NO: 27411 - protein, 22 aa, Homo sapiens
RTKVSSYPVALIPGQFQEYYKR

SEQ ID NO: 27412 - protein, 22 aa, Homo sapiens
RTKVSSYPVALIPGQFQEYYKR

SEQ ID NO: 27413 - protein, 10 aa, Homo sapiens
KYKVLPTERT

SEQ ID NO: 27414 - protein, 10 aa, Homo sapiens
KYKVLPTERT

SEQ ID NO: 27415 - protein, 23 aa, Homo sapiens
RTKVSSYPVALIPGQFQEYYKRY

SEQ ID NO: 27416 - protein, 15 aa, Homo sapiens
RSVLSKSVPGYKPKV

SEQ ID NO: 27417 - protein, 8 aa, Homo sapiens
KGKESNKK

SEQ ID NO: 27418 - protein, 31 aa, Homo sapiens
KNKGTSDSSSGNVSEGESPPDSQEDSFQGRQ

SEQ ID NO: 27419 - protein, 8 aa, Homo sapiens
RKDGPKRS

SEQ ID NO: 27420 - protein, 15 aa, Homo sapiens
RSVLSKSVPGYKPKV

SEQ ID NO: 27421 - protein, 6 aa, Homo sapiens
RKVGRR

SEQ ID NO: 27422 - protein, 6 aa, Homo sapiens
RKVGRR

SEQ ID NO: 27423 - protein, 6 aa, Homo sapiens
RKVGRR

SEQ ID NO: 27424 - protein, 15 aa, Homo sapiens
KHAEYSVILQEKERQ

SEQ ID NO: 27425 - protein, 15 aa, Homo sapiens
KHAEYSVILQEKERQ

SEQ ID NO: 27426 - protein, 8 aa, Homo sapiens
RKDGPKRS

SEQ ID NO: 27427 - protein, 9 aa, Homo sapiens
RKYPDLERR

SEQ ID NO: 27428 - protein, 10 aa, Homo sapiens
KRKYPDLERR

SEQ ID NO: 27429 - protein, 9 aa, Homo sapiens
RKYPDLERR

SEQ ID NO: 27430 - protein, 9 aa, Homo sapiens
RKYPDLERR

SEQ ID NO: 27431 - protein, 13 aa, Homo sapiens
RDLSHKEKLYLRE

SEQ ID NO: 27432 - protein, 9 aa, Homo sapiens
RDLSHKEKL

SEQ ID NO: 27433 - protein, 10 aa, Homo sapiens
RRDLSHKEKL

SEQ ID NO: 27434 - protein, 10 aa, Homo sapiens
RKYPDLERRD

SEQ ID NO: 27435 - protein, 10 aa, Homo sapiens
RKYPDLERRD

SEQ ID NO: 27436 - protein, 10 aa, Homo sapiens
RKYPDLERRD

SEQ ID NO: 27437 - protein, 6 aa, Homo sapiens
RKVGRR

SEQ ID NO: 27438 - protein, 6 aa, Homo sapiens
RKVGRR

SEQ ID NO: 27439 - protein, 9 aa, Homo sapiens
RKYPDLERR

SEQ ID NO: 27440 - protein, 9 aa, Homo sapiens
RKYPDLERR

SEQ ID NO: 27441 - protein, 10 aa, Homo sapiens
KRKYPDLERR

SEQ ID NO: 27442 - protein, 9 aa, Homo sapiens
RKYPDLERR

SEQ ID NO: 27443 - protein, 9 aa, Homo sapiens
RKYPDLERR

SEQ ID NO: 27444 - protein, 10 aa, Homo sapiens
RKYPDLERRD

SEQ ID NO: 27445 - protein, 9 aa, Homo sapiens
RKYPDLERR

SEQ ID NO: 27446 - protein, 9 aa, Homo sapiens
RKYPDLERR

SEQ ID NO: 27447 - protein, 9 aa, Homo sapiens
RKYPDLERR

SEQ ID NO: 27448 - protein, 9 aa, Homo sapiens
RKYPDLERR

SEQ ID NO: 27449 - protein, 9 aa, Homo sapiens
RKYPDLERR

SEQ ID NO: 27450 - protein, 9 aa, Homo sapiens
RKYPDLERR

SEQ ID NO: 27451 - protein, 9 aa, Homo sapiens
RKYPDLERR

SEQ ID NO: 27452 - protein, 9 aa, Homo sapiens
RKYPDLERR

SEQ ID NO: 27453 - protein, 9 aa, Homo sapiens
RKYPDLERR

SEQ ID NO: 27454 - protein, 17 aa, Homo sapiens
RSDEVIDLMIKEYPAKH

SEQ ID NO: 27455 - protein, 17 aa, Homo sapiens
RSDEVIDLMIKEYPAKH

SEQ ID NO: 27456 - protein, 9 aa, Homo sapiens
RKYPDLERR

SEQ ID NO: 27457 - protein, 15 aa, Homo sapiens
KHAEYSVILQEKERQ

SEQ ID NO: 27458 - protein, 15 aa, Homo sapiens
KHAEYSVILQEKERQ

SEQ ID NO: 27459 - protein, 15 aa, Homo sapiens
KHAEYSVILQEKERQ

SEQ ID NO: 27460 - protein, 20 aa, Homo sapiens
KEYPAKHAEYSVILQEKERQ

SEQ ID NO: 27461 - protein, 9 aa, Homo sapiens
RKYPDLERR

SEQ ID NO: 27462 - protein, 9 aa, Homo sapiens
RKYPDLERR

SEQ ID NO: 27463 - protein, 18 aa, Homo sapiens
KEYPAKHAEYSVILQEKE

SEQ ID NO: 27464 - protein, 18 aa, Homo sapiens
KEYPAKHAEYSVILQEKE

SEQ ID NO: 27465 - protein, 18 aa, Homo sapiens
KEYPAKHAEYSVILQEKE

SEQ ID NO: 27466 - protein, 18 aa, Homo sapiens
KEYPAKHAEYSVILQEKE

SEQ ID NO: 27467 - protein, 18 aa, Homo sapiens
KEYPAKHAEYSVILQEKE

SEQ ID NO: 27468 - protein, 9 aa, Homo sapiens
RKYPDLERR

SEQ ID NO: 27469 - protein, 18 aa, Homo sapiens
KEYPAKHAEYSVILQEKE

SEQ ID NO: 27470 - protein, 18 aa, Homo sapiens
KEYPAKHAEYSVILQEKE

SEQ ID NO: 27471 - protein, 9 aa, Homo sapiens
RKYPDLERR

SEQ ID NO: 27472 - protein, 9 aa, Homo sapiens
RKYPDLERR

SEQ ID NO: 27473 - protein, 9 aa, Homo sapiens
RKYPDLERR

SEQ ID NO: 27474 - protein, 18 aa, Homo sapiens
KEYPAKHAEYSVILQEKE

SEQ ID NO: 27475 - protein, 9 aa, Homo sapiens
RKYPDLERR

SEQ ID NO: 27476 - protein, 9 aa, Homo sapiens
RKYPDLERR

SEQ ID NO: 27477 - protein, 9 aa, Homo sapiens
RKYPDLERR

SEQ ID NO: 27478 - protein, 18 aa, Homo sapiens
KEYPAKHAEYSVILQEKE

SEQ ID NO: 27479 - protein, 9 aa, Homo sapiens
RKYPDLERR

SEQ ID NO: 27480 - protein, 18 aa, Homo sapiens
KEYPAKHAEYSVILQEKE

SEQ ID NO: 27481 - protein, 9 aa, Homo sapiens
RKYPDLERR

SEQ ID NO: 27482 - protein, 9 aa, Homo sapiens
RKYPDLERR

SEQ ID NO: 27483 - protein, 10 aa, Homo sapiens
KRKYPDLERR

SEQ ID NO: 27484 - protein, 9 aa, Homo sapiens
RKYPDLERR

SEQ ID NO: 27485 - protein, 18 aa, Homo sapiens
KEYPAKHAEYSVILQEKE

SEQ ID NO: 27486 - protein, 18 aa, Homo sapiens
KEYPAKHAEYSVILQEKE

SEQ ID NO: 27487 - protein, 18 aa, Homo sapiens
KEYPAKHAEYSVILQEKE

SEQ ID NO: 27488 - protein, 9 aa, Homo sapiens
RKYPDLERR

SEQ ID NO: 27489 - protein, 9 aa, Homo sapiens
RKYPDLERR

SEQ ID NO: 27490 - protein, 18 aa, Homo sapiens
KEYPAKHAEYSVILQEKE

SEQ ID NO: 27491 - protein, 18 aa, Homo sapiens
KEYPAKHAEYSVILQEKE

SEQ ID NO: 27492 - protein, 18 aa, Homo sapiens
KEYPAKHAEYSVILQEKE

SEQ ID NO: 27493 - protein, 9 aa, Homo sapiens
RKYPDLERR

SEQ ID NO: 27494 - protein, 18 aa, Homo sapiens
KEYPAKHAEYSVILQEKE

SEQ ID NO: 27495 - protein, 18 aa, Homo sapiens
KEYPAKHAEYSVILQEKE

SEQ ID NO: 27496 - protein, 18 aa, Homo sapiens
KEYPAKHAEYSVILQEKE

SEQ ID NO: 27497 - protein, 18 aa, Homo sapiens
KEYPAKHAEYSVILQEKE

SEQ ID NO: 27498 - protein, 18 aa, Homo sapiens
KEYPAKHAEYSVILQEKE

SEQ ID NO: 27499 - protein, 18 aa, Homo sapiens
KEYPAKHAEYSVILQEKE

SEQ ID NO: 27500 - protein, 18 aa, Homo sapiens
KEYPAKHAEYSVILQEKE

SEQ ID NO: 27501 - protein, 18 aa, Homo sapiens
KEYPAKHAEYSVILQEKE

SEQ ID NO: 27502 - protein, 9 aa, Homo sapiens
RKYPDLERR

SEQ ID NO: 27503 - protein, 18 aa, Homo sapiens
KEYPAKHAEYSVILQEKE

SEQ ID NO: 27504 - protein, 18 aa, Homo sapiens
KEYPAKHAEYSVILQEKE

SEQ ID NO: 27505 - protein, 18 aa, Homo sapiens
KEYPAKHAEYSVILQEKE

SEQ ID NO: 27506 - protein, 18 aa, Homo sapiens
KEYPAKHAEYSVILQEKE

SEQ ID NO: 27507 - protein, 20 aa, Homo sapiens
KEYPAKHAEYSVILQEKERQ

SEQ ID NO: 27508 - protein, 18 aa, Homo sapiens
KEYPAKHAEYSVILQEKE

SEQ ID NO: 27509 - protein, 18 aa, Homo sapiens
KEYPAKHAEYSVILQEKE

SEQ ID NO: 27510 - protein, 18 aa, Homo sapiens
KEYPAKHAEYSVILQEKE

SEQ ID NO: 27511 - protein, 20 aa, Homo sapiens
KEYPAKHAEYSVILQEKERQ

SEQ ID NO: 27512 - protein, 18 aa, Homo sapiens
KEYPAKHAEYSVILQEKE

SEQ ID NO: 27513 - protein, 18 aa, Homo sapiens
KEYPAKHAEYSVILQEKE

SEQ ID NO: 27514 - protein, 20 aa, Homo sapiens
KEYPAKHAEYSVILQEKERQ

SEQ ID NO: 27515 - protein, 18 aa, Homo sapiens
KEYPAKHAEYSVILQEKE

SEQ ID NO: 27516 - protein, 20 aa, Homo sapiens
KEYPAKHAEYSVILQEKERQ

SEQ ID NO: 27517 - protein, 18 aa, Homo sapiens
KEYPAKHAEYSVILQEKE

SEQ ID NO: 27518 - protein, 20 aa, Homo sapiens
KEYPAKHAEYSVILQEKERQ

SEQ ID NO: 27519 - protein, 18 aa, Homo sapiens
KEYPAKHAEYSVILQEKE

SEQ ID NO: 27520 - protein, 18 aa, Homo sapiens
KEYPAKHAEYSVILQEKE

SEQ ID NO: 27521 - protein, 18 aa, Homo sapiens
KEYPAKHAEYSVILQEKE

SEQ ID NO: 27522 - protein, 18 aa, Homo sapiens
KEYPAKHAEYSVILQEKE

SEQ ID NO: 27523 - protein, 23 aa, Homo sapiens
RTKVSSYPVALIPGQFQEYYKRY

SEQ ID NO: 27524 - protein, 7 aa, Homo sapiens
KKAAKKA

SEQ ID NO: 27525 - protein, 13 aa, Homo sapiens
KKAAEFNSNLNRE

SEQ ID NO: 27526 - protein, 13 aa, Homo sapiens
KKAAEFNSNLNRE

SEQ ID NO: 27527 - protein, 6 aa, Homo sapiens
KKAAKK

SEQ ID NO: 27528 - protein, 15 aa, Homo sapiens
KHAEYSVILQEKERQ

SEQ ID NO: 27529 - protein, 9 aa, Homo sapiens
KDKAATPRK

SEQ ID NO: 27530 - protein, 15 aa, Homo sapiens
KHAEYSVILQEKERQ

SEQ ID NO: 27531 - protein, 15 aa, Homo sapiens
KHAEYSVILQEKERQ

SEQ ID NO: 27532 - protein, 15 aa, Homo sapiens
KHAEYSVILQEKERQ

SEQ ID NO: 27533 - protein, 15 aa, Homo sapiens
KHAEYSVILQEKERQ

SEQ ID NO: 27534 - protein, 15 aa, Homo sapiens
KHAEYSVILQEKERQ

SEQ ID NO: 27535 - protein, 15 aa, Homo sapiens
KHAEYSVILQEKERQ

SEQ ID NO: 27536 - protein, 6 aa, Homo sapiens
RKVGRR

SEQ ID NO: 27537 - protein, 6 aa, Homo sapiens
RKVGRR

SEQ ID NO: 27538 - protein, 15 aa, Homo sapiens
KHAEYSVILQEKERQ

SEQ ID NO: 27539 - protein, 15 aa, Homo sapiens
KHAEYSVILQEKERQ

SEQ ID NO: 27540 - protein, 11 aa, Homo sapiens
KSKDKAATPRK

SEQ ID NO: 27541 - protein, 7 aa, Homo sapiens
RKDGPKR

SEQ ID NO: 27542 - protein, 5 aa, Homo sapiens
IEKER

SEQ ID NO: 27543 - protein, 14 aa, Homo sapiens
GRPPAEKLSPNPPK

SEQ ID NO: 27544 - protein, 14 aa, Homo sapiens
GRPPAEKLSPNPPK

SEQ ID NO: 27545 - protein, 14 aa, Homo sapiens
GRPPAEKLSPNPPK

SEQ ID NO: 27546 - protein, 5 aa, Homo sapiens
IEKER

SEQ ID NO: 27547 - protein, 26 aa, Homo sapiens
LTALLLPPDPIVINHVISVDPSDQKK

SEQ ID NO: 27548 - protein, 17 aa, Homo sapiens
IPAVGGKELDLHGLYTR

SEQ ID NO: 27549 - protein, 17 aa, Homo sapiens
IPAVGGKELDLHGLYTR

SEQ ID NO: 27550 - protein, 17 aa, Homo sapiens
IPAVGGKELDLHGLYTR

SEQ ID NO: 27551 - protein, 16 aa, Homo sapiens
SSTKQPTVGGTSSTPR

SEQ ID NO: 27552 - protein, 16 aa, Homo sapiens
SSTKQPTVGGTSSTPR

SEQ ID NO: 27553 - protein, 16 aa, Homo sapiens
SSTKQPTVGGTSSTPR

SEQ ID NO: 27554 - protein, 16 aa, Homo sapiens
SSTKQPTVGGTSSTPR

SEQ ID NO: 27555 - protein, 12 aa, Homo sapiens
DFTDEKEGPITK

SEQ ID NO: 27556 - protein, 12 aa, Homo sapiens
DFTDEKEGPITK

SEQ ID NO: 27557 - protein, 12 aa, Homo sapiens
DFTDEKEGPITK

SEQ ID NO: 27558 - protein, 11 aa, Homo sapiens
KIEVMENPSCR

SEQ ID NO: 27559 - protein, 11 aa, Homo sapiens
KIEVMENPSCR

SEQ ID NO: 27560 - protein, 11 aa, Homo sapiens
KIEVMENPSCR

SEQ ID NO: 27561 - protein, 7 aa, Homo sapiens
YLEKYEK

SEQ ID NO: 27562 - protein, 41 aa, Homo sapiens; identical to SEQ ID NO: 26453

SEQ ID NO: 27563 - protein, 28 aa, Homo sapiens
RKPDGTTTLGLLHPVDPIVGEPGYCPVR

SEQ ID NO: 27564 - protein, 28 aa, Homo sapiens
RKPDGTTTLGLLHPVDPIVGEPGYCPVR

SEQ ID NO: 27565 - protein, 8 aa, Homo sapiens
FKSNNLER

SEQ ID NO: 27566 - protein, 8 aa, Homo sapiens
FKSNNLER

SEQ ID NO: 27567 - protein, 13 aa, Homo sapiens
SDGDPIVDPEKEK

SEQ ID NO: 27568 - protein, 13 aa, Homo sapiens
SDGDPIVDPEKEK

SEQ ID NO: 27569 - protein, 13 aa, Homo sapiens
SDGDPIVDPEKEK

SEQ ID NO: 27570 - protein, 13 aa, Homo sapiens
SDGDPIVDPEKEK

SEQ ID NO: 27571 - protein, 19 aa, Homo sapiens
EGGGAIEEEAKEKTSEAPK

SEQ ID NO: 27572 - protein, 8 aa, Homo sapiens
EKTSEAPK

SEQ ID NO: 27573 - protein, 8 aa, Homo sapiens
EKTSEAPK

SEQ ID NO: 27574 - protein, 10 aa, Homo sapiens
EGDSEKESEK

SEQ ID NO: 27575 - protein, 10 aa, Homo sapiens
EGDSEKESEK

SEQ ID NO: 27576 - protein, 8 aa, Homo sapiens
EKTSEAPK

SEQ ID NO: 27577 - protein, 8 aa, Homo sapiens
EKTSEAPK

SEQ ID NO: 27578 - protein, 19 aa, Homo sapiens
EGGGAIEEEAKEKTSEAPK

SEQ ID NO: 27579 - protein, 19 aa, Homo sapiens
EGGGAIEEEAKEKTSEAPK

SEQ ID NO: 27580 - protein, 19 aa, Homo sapiens
EGGGAIEEEAKEKTSEAPK

SEQ ID NO: 27581 - protein, 19 aa, Homo sapiens
EGGGAIEEEAKEKTSEAPK

SEQ ID NO: 27582 - protein, 8 aa, Homo sapiens
EKTSEAPK

SEQ ID NO: 27583 - protein, 8 aa, Homo sapiens
EKTSEAPK

SEQ ID NO: 27584 - protein, 8 aa, Homo sapiens
EKTSEAPK

SEQ ID NO: 27585 - protein, 8 aa, Homo sapiens
EKTSEAPK

SEQ ID NO: 27586 - protein, 8 aa, Homo sapiens
EKTSEAPK

SEQ ID NO: 27587 - protein, 8 aa, Homo sapiens
EKTSEAPK

SEQ ID NO: 27588 - protein, 17 aa, Homo sapiens
EGQEEVLKEVVESEGER

SEQ ID NO: 27589 - protein, 17 aa, Homo sapiens
EGQEEVLKEVVESEGER

SEQ ID NO: 27590 - protein, 18 aa, Homo sapiens
ISAKTLTDEVNSPDSDRR

SEQ ID NO: 27591 - protein, 18 aa, Homo sapiens
ISAKTLTDEVNSPDSDRR

SEQ ID NO: 27592 - protein, 18 aa, Homo sapiens
ISAKTLTDEVNSPDSDRR

SEQ ID NO: 27593 - protein, 18 aa, Homo sapiens
ISAKTLTDEVNSPDSDRR

SEQ ID NO: 27594 - protein, 18 aa, Homo sapiens
ISAKTLTDEVNSPDSDRR

SEQ ID NO: 27595 - protein, 12 aa, Homo sapiens
EKPTDMQNFGLR

SEQ ID NO: 27596 - protein, 13 aa, Homo sapiens
EGGGAIEEEAKEK

SEQ ID NO: 27597 - protein, 13 aa, Homo sapiens
EGGGAIEEEAKEK

SEQ ID NO: 27598 - protein, 13 aa, Homo sapiens
EGGGAIEEEAKEK

SEQ ID NO: 27599 - protein, 13 aa, Homo sapiens
EGGGAIEEEAKEK

SEQ ID NO: 27600 - protein, 19 aa, Homo sapiens
EGGGAIEEEAKEKTSEAPK

SEQ ID NO: 27601 - protein, 13 aa, Homo sapiens
EGGGAIEEEAKEK

SEQ ID NO: 27602 - protein, 13 aa, Homo sapiens
EGGGAIEEEAKEK

SEQ ID NO: 27603 - protein, 19 aa, Homo sapiens
EGGGAIEEEAKEKTSEAPK

SEQ ID NO: 27604 - protein, 13 aa, Homo sapiens
EGGGAIEEEAKEK

SEQ ID NO: 27605 - protein, 13 aa, Homo sapiens
EGGGAIEEEAKEK

SEQ ID NO: 27606 - protein, 36 aa, Homo sapiens; identical to SEQ ID NO: 8480

SEQ ID NO: 27607 - protein, 36 aa, Homo sapiens; identical to SEQ ID NO: 8480

SEQ ID NO: 27608 - protein, 36 aa, Homo sapiens; identical to SEQ ID NO: 8480

SEQ ID NO: 27609 - protein, 36 aa, Homo sapiens; identical to SEQ ID NO: 8480

SEQ ID NO: 27610 - protein, 36 aa, Homo sapiens; identical to SEQ ID NO: 8480

SEQ ID NO: 27611 - protein, 36 aa, Homo sapiens; identical to SEQ ID NO: 8480

SEQ ID NO: 27612 - protein, 26 aa, Homo sapiens
VTGKADPAFGLESSGIAGTTSDEPER

SEQ ID NO: 27613 - protein, 26 aa, Homo sapiens
VTGKADPAFGLESSGIAGTTSDEPER

SEQ ID NO: 27614 - protein, 17 aa, Homo sapiens
EGQEEVLKEVVESEGER

SEQ ID NO: 27615 - protein, 10 aa, Homo sapiens
AKHLAAVEER

SEQ ID NO: 27616 - protein, 10 aa, Homo sapiens
AKHLAAVEER

SEQ ID NO: 27617 - protein, 10 aa, Homo sapiens
AKHLAAVEER

SEQ ID NO: 27618 - protein, 7 aa, Homo sapiens
KVEEAAK

SEQ ID NO: 27619 - protein, 7 aa, Homo sapiens
KVEEAAK

SEQ ID NO: 27620 - protein, 13 aa, Homo sapiens
VEGQATDEKKEPK

SEQ ID NO: 27621 - protein, 16 aa, Homo sapiens
SDGDPIVDPEKEKEPK

SEQ ID NO: 27622 - protein, 16 aa, Homo sapiens
SDGDPIVDPEKEKEPK

SEQ ID NO: 27623 - protein, 16 aa, Homo sapiens
SDGDPIVDPEKEKEPK

SEQ ID NO: 27624 - protein, 15 aa, Homo sapiens
ESEKSDGDPIVDPEK

SEQ ID NO: 27625 - protein, 15 aa, Homo sapiens
ESEKSDGDPIVDPEK

SEQ ID NO: 27626 - protein, 15 aa, Homo sapiens
ESEKSDGDPIVDPEK

SEQ ID NO: 27627 - protein, 6 aa, Homo sapiens
KTKVER

SEQ ID NO: 27628 - protein, 6 aa, Homo sapiens
KTKVER

SEQ ID NO: 27629 - protein, 6 aa, Homo sapiens
KTKVER

SEQ ID NO: 27630 - protein, 6 aa, Homo sapiens
KTKVER

SEQ ID NO: 27631 - protein, 17 aa, Homo sapiens
EGQEEVLKEVVESEGER

SEQ ID NO: 27632 - protein, 6 aa, Homo sapiens
KTKVER

SEQ ID NO: 27633 - protein, 6 aa, Homo sapiens
KTKVER

SEQ ID NO: 27634 - protein, 6 aa, Homo sapiens
KTKVER

SEQ ID NO: 27635 - protein, 6 aa, Homo sapiens
KTKVER

SEQ ID NO: 27636 - protein, 17 aa, Homo sapiens
EGQEEVLKEVVESEGER

SEQ ID NO: 27637 - protein, 17 aa, Homo sapiens
EGQEEVLKEVVESEGER

SEQ ID NO: 27638 - protein, 17 aa, Homo sapiens
EGQEEVLKEVVESEGER

SEQ ID NO: 27639 - protein, 17 aa, Homo sapiens
EGQEEVLKEVVESEGER

SEQ ID NO: 27640 - protein, 17 aa, Homo sapiens
EGQEEVLKEVVESEGER

SEQ ID NO: 27641 - protein, 17 aa, Homo sapiens
EGQEEVLKEVVESEGER

SEQ ID NO: 27642 - protein, 17 aa, Homo sapiens
EGQEEVLKEVVESEGER

SEQ ID NO: 27643 - protein, 17 aa, Homo sapiens
EGQEEVLKEVVESEGER

SEQ ID NO: 27644 - protein, 17 aa, Homo sapiens
EGQEEVLKEVVESEGER

SEQ ID NO: 27645 - protein, 17 aa, Homo sapiens
EGQEEVLKEVVESEGER

SEQ ID NO: 27646 - protein, 17 aa, Homo sapiens
EGQEEVLKEVVESEGER

SEQ ID NO: 27647 - protein, 17 aa, Homo sapiens
EGQEEVLKEVVESEGER

SEQ ID NO: 27648 - protein, 17 aa, Homo sapiens
EGQEEVLKEVVESEGER

SEQ ID NO: 27649 - protein, 17 aa, Homo sapiens
EGQEEVLKEVVESEGER

SEQ ID NO: 27650 - protein, 17 aa, Homo sapiens
EGQEEVLKEVVESEGER

SEQ ID NO: 27651 - protein, 17 aa, Homo sapiens
EGQEEVLKEVVESEGER

SEQ ID NO: 27652 - protein, 17 aa, Homo sapiens
EGQEEVLKEVVESEGER

SEQ ID NO: 27653 - protein, 7 aa, Homo sapiens
KVEEAAK

SEQ ID NO: 27654 - protein, 15 aa, Homo sapiens
MKEEVPTALVEAHVR

SEQ ID NO: 27655 - protein, 15 aa, Homo sapiens
MKEEVPTALVEAHVR

SEQ ID NO: 27656 - protein, 6 aa, Homo sapiens
KTKVER

SEQ ID NO: 27657 - protein, 5 aa, Homo sapiens
TKVER

SEQ ID NO: 27658 - protein, 15 aa, Homo sapiens
MKEEVPTALVEAHVR

SEQ ID NO: 27659 - protein, 10 aa, Homo sapiens
AKHLAAVEER

SEQ ID NO: 27660 - protein, 15 aa, Homo sapiens
MKEEVPTALVEAHVR

SEQ ID NO: 27661 - protein, 15 aa, Homo sapiens
MKEEVPTALVEAHVR

SEQ ID NO: 27662 - protein, 15 aa, Homo sapiens
MKEEVPTALVEAHVR

SEQ ID NO: 27663 - protein, 10 aa, Homo sapiens
AKHLAAVEER

SEQ ID NO: 27664 - protein, 10 aa, Homo sapiens
AKHLAAVEER

SEQ ID NO: 27665 - protein, 10 aa, Homo sapiens
AKHLAAVEER

SEQ ID NO: 27666 - protein, 10 aa, Homo sapiens
AKHLAAVEER

SEQ ID NO: 27667 - protein, 10 aa, Homo sapiens
AKHLAAVEER

SEQ ID NO: 27668 - protein, 10 aa, Homo sapiens
AKHLAAVEER

SEQ ID NO: 27669 - protein, 15 aa, Homo sapiens
MKEEVPTALVEAHVR

SEQ ID NO: 27670 - protein, 15 aa, Homo sapiens
MKEEVPTALVEAHVR

SEQ ID NO: 27671 - protein, 10 aa, Homo sapiens
AKHLAAVEER

SEQ ID NO: 27672 - protein, 15 aa, Homo sapiens
MKEEVPTALVEAHVR

SEQ ID NO: 27673 - protein, 15 aa, Homo sapiens
VASAAAKSALEEFSK

SEQ ID NO: 27674 - protein, 15 aa, Homo sapiens
VASAAAKSALEEFSK

SEQ ID NO: 27675 - protein, 15 aa, Homo sapiens
VASAAAKSALEEFSK

SEQ ID NO: 27676 - protein, 15 aa, Homo sapiens
VASAAAKSALEEFSK

SEQ ID NO: 27677 - protein, 15 aa, Homo sapiens
VASAAAKSALEEFSK

SEQ ID NO: 27678 - protein, 15 aa, Homo sapiens
VASAAAKSALEEFSK

SEQ ID NO: 27679 - protein, 15 aa, Homo sapiens
VASAAAKSALEEFSK

SEQ ID NO: 27680 - protein, 15 aa, Homo sapiens
VASAAAKSALEEFSK

SEQ ID NO: 27681 - protein, 15 aa, Homo sapiens
VASAAAKSALEEFSK

SEQ ID NO: 27682 - protein, 15 aa, Homo sapiens
VASAAAKSALEEFSK

SEQ ID NO: 27683 - protein, 15 aa, Homo sapiens
VASAAAKSALEEFSK

SEQ ID NO: 27684 - protein, 15 aa, Homo sapiens
VASAAAKSALEEFSK

SEQ ID NO: 27685 - protein, 15 aa, Homo sapiens
VASAAAKSALEEFSK

SEQ ID NO: 27686 - protein, 15 aa, Homo sapiens
VASAAAKSALEEFSK

SEQ ID NO: 27687 - protein, 15 aa, Homo sapiens
VASAAAKSALEEFSK

SEQ ID NO: 27688 - protein, 15 aa, Homo sapiens
VASAAAKSALEEFSK

SEQ ID NO: 27689 - protein, 15 aa, Homo sapiens
VASAAAKSALEEFSK

SEQ ID NO: 27690 - protein, 10 aa, Homo sapiens
AKHLAAVEER

SEQ ID NO: 27691 - protein, 15 aa, Homo sapiens
VASAAAKSALEEFSK

SEQ ID NO: 27692 - protein, 15 aa, Homo sapiens
VASAAAKSALEEFSK

SEQ ID NO: 27693 - protein, 15 aa, Homo sapiens
VASAAAKSALEEFSK

SEQ ID NO: 27694 - protein, 15 aa, Homo sapiens
VASAAAKSALEEFSK

SEQ ID NO: 27695 - protein, 10 aa, Homo sapiens
AKHLAAVEER

SEQ ID NO: 27696 - protein, 13 aa, Homo sapiens
VEGQATDEKKEPK

SEQ ID NO: 27697 - protein, 20 aa, Homo sapiens
IEESGNDEARVEGQATDEKK

SEQ ID NO: 27698 - protein, 10 aa, Homo sapiens
VEGQATDEKK

SEQ ID NO: 27699 - protein, 20 aa, Homo sapiens
IEESGNDEARVEGQATDEKK

SEQ ID NO: 27700 - protein, 10 aa, Homo sapiens
VEGQATDEKK

SEQ ID NO: 27701 - protein, 6 aa, Homo sapiens
EPKEPR

SEQ ID NO: 27702 - protein, 10 aa, Homo sapiens
VEGQATDEKK

SEQ ID NO: 27703 - protein, 6 aa, Homo sapiens
EPKEPR

SEQ ID NO: 27704 - protein, 6 aa, Homo sapiens
EPKEPR

SEQ ID NO: 27705 - protein, 6 aa, Homo sapiens
EPKEPR

SEQ ID NO: 27706 - protein, 6 aa, Homo sapiens
EPKEPR

SEQ ID NO: 27707 - protein, 6 aa, Homo sapiens
EPKEPR

SEQ ID NO: 27708 - protein, 6 aa, Homo sapiens
EPKEPR

SEQ ID NO: 27709 - protein, 10 aa, Homo sapiens
VEGQATDEKK

SEQ ID NO: 27710 - protein, 6 aa, Homo sapiens
EPKEPR

SEQ ID NO: 27711 - protein, 10 aa, Homo sapiens
VEGQATDEKK

SEQ ID NO: 27712 - protein, 6 aa, Homo sapiens
EPKEPR

SEQ ID NO: 27713 - protein, 10 aa, Homo sapiens
VEGQATDEKK

SEQ ID NO: 27714 - protein, 11 aa, Homo sapiens
KVEEAAKVTGK

SEQ ID NO: 27715 - protein, 9 aa, Homo sapiens
SKAAASATR

SEQ ID NO: 27716 - protein, 9 aa, Homo sapiens
SKAAASATR

SEQ ID NO: 27717 - protein, 36 aa, Homo sapiens; identical to SEQ ID NO: 8480

SEQ ID NO: 27718 - protein, 36 aa, Homo sapiens; identical to SEQ ID NO: 8480

SEQ ID NO: 27719 - protein, 13 aa, Homo sapiens
DALVLHKVLLETR

SEQ ID NO: 27720 - protein, 6 aa, Homo sapiens
NYTDKR

SEQ ID NO: 27721 - protein, 13 aa, Homo sapiens
DALVLHKVLLETR

SEQ ID NO: 27722 - protein, 19 aa, Homo sapiens
EAEKSEDSSGAAGLSGLHR

SEQ ID NO: 27723 - protein, 7 aa, Homo sapiens
KNVENNR

SEQ ID NO: 27724 - protein, 7 aa, Homo sapiens
KNVENNR

SEQ ID NO: 27725 - protein, 7 aa, Homo sapiens
KNVENNR

SEQ ID NO: 27726 - protein, 7 aa, Homo sapiens
KNVENNR

SEQ ID NO: 27727 - protein, 7 aa, Homo sapiens
KNVENNR

SEQ ID NO: 27728 - protein, 24 aa, Homo sapiens
VASVFANADKGDDEKNTDNSEDSR

SEQ ID NO: 27729 - protein, 24 aa, Homo sapiens
VASVFANADKGDDEKNTDNSEDSR

SEQ ID NO: 27730 - protein, 24 aa, Homo sapiens
VASVFANADKGDDEKNTDNSEDSR

SEQ ID NO: 27731 - protein, 15 aa, Homo sapiens
VASVFANADKGDDEK

SEQ ID NO: 27732 - protein, 15 aa, Homo sapiens
VASVFANADKGDDEK

SEQ ID NO: 27733 - protein, 24 aa, Homo sapiens
VASVFANADKGDDEKNTDNSEDSR

SEQ ID NO: 27734 - protein, 24 aa, Homo sapiens
VASVFANADKGDDEKNTDNSEDSR

SEQ ID NO: 27735 - protein, 15 aa, Homo sapiens
VASVFANADKGDDEK

SEQ ID NO: 27736 - protein, 24 aa, Homo sapiens
VASVFANADKGDDEKNTDNSEDSR

SEQ ID NO: 27737 - protein, 15 aa, Homo sapiens
VASVFANADKGDDEK

SEQ ID NO: 27738 - protein, 15 aa, Homo sapiens
VASVFANADKGDDEK

SEQ ID NO: 27739 - protein, 24 aa, Homo sapiens
VASVFANADKGDDEKNTDNSEDSR

SEQ ID NO: 27740 - protein, 15 aa, Homo sapiens
VASVFANADKGDDEK

SEQ ID NO: 27741 - protein, 24 aa, Homo sapiens
VASVFANADKGDDEKNTDNSEDSR

SEQ ID NO: 27742 - protein, 24 aa, Homo sapiens
VASVFANADKGDDEKNTDNSEDSR

SEQ ID NO: 27743 - protein, 24 aa, Homo sapiens
VASVFANADKGDDEKNTDNSEDSR

SEQ ID NO: 27744 - protein, 24 aa, Homo sapiens
VASVFANADKGDDEKNTDNSEDSR

SEQ ID NO: 27745 - protein, 22 aa, Homo sapiens
VQYPDYYAIIKEPIDLKTIAQR

SEQ ID NO: 27746 - protein, 11 aa, Homo sapiens
EPIDLKTIAQR

SEQ ID NO: 27747 - protein, 11 aa, Homo sapiens
EPIDLKTIAQR

SEQ ID NO: 27748 - protein, 11 aa, Homo sapiens
EPIDLKTIAQR

SEQ ID NO: 27749 - protein, 11 aa, Homo sapiens
EPIDLKTIAQR

SEQ ID NO: 27750 - protein, 11 aa, Homo sapiens
EPIDLKTIAQR

SEQ ID NO: 27751 - protein, 12 aa, Homo sapiens
LISELFQKLPSK

SEQ ID NO: 27752 - protein, 22 aa, Homo sapiens
VQYPDYYAIIKEPIDLKTIAQR

SEQ ID NO: 27753 - protein, 22 aa, Homo sapiens
VQYPDYYAIIKEPIDLKTIAQR

SEQ ID NO: 27754 - protein, 12 aa, Homo sapiens
LISELFQKLPSK

SEQ ID NO: 27755 - protein, 12 aa, Homo sapiens
LISELFQKLPSK

SEQ ID NO: 27756 - protein, 22 aa, Homo sapiens
VQYPDYYAIIKEPIDLKTIAQR

SEQ ID NO: 27757 - protein, 12 aa, Homo sapiens
LISELFQKLPSK

SEQ ID NO: 27758 - protein, 12 aa, Homo sapiens
LISELFQKLPSK

SEQ ID NO: 27759 - protein, 12 aa, Homo sapiens
LISELFQKLPSK

SEQ ID NO: 27760 - protein, 12 aa, Homo sapiens
LISELFQKLPSK

SEQ ID NO: 27761 - protein, 12 aa, Homo sapiens
LISELFQKLPSK

SEQ ID NO: 27762 - protein, 11 aa, Homo sapiens
EPIDLKTIAQR

SEQ ID NO: 27763 - protein, 22 aa, Homo sapiens
VQYPDYYAIIKEPIDLKTIAQR

SEQ ID NO: 27764 - protein, 22 aa, Homo sapiens
VQYPDYYAIIKEPIDLKTIAQR

SEQ ID NO: 27765 - protein, 17 aa, Homo sapiens
AVIKAQHPDYSFGELSR

SEQ ID NO: 27766 - protein, 16 aa, Homo sapiens
VGDCVFIKSHGLVRPR

SEQ ID NO: 27767 - protein, 16 aa, Homo sapiens
VGDCVFIKSHGLVRPR

SEQ ID NO: 27768 - protein, 16 aa, Homo sapiens
VGDCVFIKSHGLVRPR

SEQ ID NO: 27769 - protein, 24 aa, Homo sapiens
VASVFANADKGDDEKNTDNSEDSR

SEQ ID NO: 27770 - protein, 24 aa, Homo sapiens
VASVFANADKGDDEKNTDNSEDSR

SEQ ID NO: 27771 - protein, 24 aa, Homo sapiens
VASVFANADKGDDEKNTDNSEDSR

SEQ ID NO: 27772 - protein, 24 aa, Homo sapiens
VASVFANADKGDDEKNTDNSEDSR

SEQ ID NO: 27773 - protein, 15 aa, Homo sapiens
LTGPSHSKGSLGEER

SEQ ID NO: 27774 - protein, 11 aa, Homo sapiens
DVHLSKEQESR

SEQ ID NO: 27775 - protein, 8 aa, Homo sapiens
NPTSKYYR

SEQ ID NO: 27776 - protein, 8 aa, Homo sapiens
NPTSKYYR

SEQ ID NO: 27777 - protein, 11 aa, Homo sapiens
YNVPNSAIYKR

SEQ ID NO: 27778 - protein, 8 aa, Homo sapiens
NPTSKYYR

SEQ ID NO: 27779 - protein, 8 aa, Homo sapiens
NPTSKYYR

SEQ ID NO: 27780 - protein, 23 aa, Homo sapiens
RDDIEDGDSMISSATSDTGSAKR

SEQ ID NO: 27781 - protein, 12 aa, Homo sapiens
MKILFNVVLEAR

SEQ ID NO: 27782 - protein, 12 aa, Homo sapiens
MKILFNVVLEAR

SEQ ID NO: 27783 - protein, 12 aa, Homo sapiens
MKILFNVVLEAR

SEQ ID NO: 27784 - protein, 12 aa, Homo sapiens
MKILFNVVLEAR

SEQ ID NO: 27785 - protein, 12 aa, Homo sapiens
MKILFNVVLEAR

SEQ ID NO: 27786 - protein, 7 aa, Homo sapiens
KNVENNR

SEQ ID NO: 27787 - protein, 6 aa, Homo sapiens
YSAKTK

SEQ ID NO: 27788 - protein, 19 aa, Homo sapiens
EAEKSEDSSGAAGLSGLHR

SEQ ID NO: 27789 - protein, 9 aa, Homo sapiens
EIEEDKLKR

SEQ ID NO: 27790 - protein, 10 aa, Homo sapiens
AAKVAEQQER

SEQ ID NO: 27791 - protein, 10 aa, Homo sapiens
AAKVAEQQER

SEQ ID NO: 27792 - protein, 10 aa, Homo sapiens
AAKVAEQQER

SEQ ID NO: 27793 - protein, 18 aa, Homo sapiens
YPDYYQQIKMPISLQQIR

SEQ ID NO: 27794 - protein, 19 aa, Homo sapiens
EAEKSEDSSGAAGLSGLHR

SEQ ID NO: 27795 - protein, 19 aa, Homo sapiens
EAEKSEDSSGAAGLSGLHR

SEQ ID NO: 27796 - protein, 19 aa, Homo sapiens
EAEKSEDSSGAAGLSGLHR

SEQ ID NO: 27797 - protein, 15 aa, Homo sapiens
KPIVPQKEPSPLLEK

SEQ ID NO: 27798 - protein, 6 aa, Homo sapiens
KKELAR

SEQ ID NO: 27799 - protein, 11 aa, Homo sapiens
VLKLQQVMQAK

SEQ ID NO: 27800 - protein, 6 aa, Homo sapiens
KKELAR

SEQ ID NO: 27801 - protein, 11 aa, Homo sapiens
VLKLQQVMQAK

SEQ ID NO: 27802 - protein, 11 aa, Homo sapiens
EPIDLKTIAQR

SEQ ID NO: 27803 - protein, 11 aa, Homo sapiens
EPIDLKTIAQR

SEQ ID NO: 27804 - protein, 11 aa, Homo sapiens
EPIDLKTIAQR

SEQ ID NO: 27805 - protein, 11 aa, Homo sapiens
EPIDLKTIAQR

SEQ ID NO: 27806 - protein, 11 aa, Homo sapiens
EPIDLKTIAQR

SEQ ID NO: 27807 - protein, 11 aa, Homo sapiens
EPIDLKTIAQR

SEQ ID NO: 27808 - protein, 11 aa, Homo sapiens
EPIDLKTIAQR

SEQ ID NO: 27809 - protein, 11 aa, Homo sapiens
EPIDLKTIAQR

SEQ ID NO: 27810 - protein, 11 aa, Homo sapiens
EPIDLKTIAQR

SEQ ID NO: 27811 - protein, 10 aa, Homo sapiens
HLHNDVEKER

SEQ ID NO: 27812 - protein, 11 aa, Homo sapiens
LPKEIEEDKLK

SEQ ID NO: 27813 - protein, 11 aa, Homo sapiens
LPKEIEEDKLK

SEQ ID NO: 27814 - protein, 10 aa, Homo sapiens
HLHNDVEKER

SEQ ID NO: 27815 - protein, 6 aa, Homo sapiens
KKELAR

SEQ ID NO: 27816 - protein, 5 aa, Homo sapiens
KELAR

SEQ ID NO: 27817 - protein, 6 aa, Homo sapiens
KKELAR

SEQ ID NO: 27818 - protein, 6 aa, Homo sapiens
KKELAR

SEQ ID NO: 27819 - protein, 15 aa, Homo sapiens
LNEVYEAVKNYTDKR

SEQ ID NO: 27820 - protein, 8 aa, Homo sapiens
EIEEDKLK

SEQ ID NO: 27821 - protein, 9 aa, Homo sapiens
EIEEDKLKR

SEQ ID NO: 27822 - protein, 19 aa, Homo sapiens
EAEKSEDSSGAAGLSGLHR

SEQ ID NO: 27823 - protein, 19 aa, Homo sapiens
EAEKSEDSSGAAGLSGLHR

SEQ ID NO: 27824 - protein, 19 aa, Homo sapiens
EAEKSEDSSGAAGLSGLHR

SEQ ID NO: 27825 - protein, 19 aa, Homo sapiens
EAEKSEDSSGAAGLSGLHR

SEQ ID NO: 27826 - protein, 11 aa, Homo sapiens
DVHLSKEQESR

SEQ ID NO: 27827 - protein, 24 aa, Homo sapiens
VASVFANADKGDDEKNTDNSEDSR

SEQ ID NO: 27828 - protein, 24 aa, Homo sapiens
VASVFANADKGDDEKNTDNSEDSR

SEQ ID NO: 27829 - protein, 14 aa, Homo sapiens
GDDEKNTDNSEDSR

SEQ ID NO: 27830 - protein, 24 aa, Homo sapiens
VASVFANADKGDDEKNTDNSEDSR

SEQ ID NO: 27831 - protein, 24 aa, Homo sapiens
VASVFANADKGDDEKNTDNSEDSR

SEQ ID NO: 27832 - protein, 24 aa, Homo sapiens
VASVFANADKGDDEKNTDNSEDSR

SEQ ID NO: 27833 - protein, 10 aa, Homo sapiens
AAKVAEQQER

SEQ ID NO: 27834 - protein, 11 aa, Homo sapiens
YNVPNSAIYKR

SEQ ID NO: 27835 - protein, 11 aa, Homo sapiens
YNVPNSAIYKR

SEQ ID NO: 27836 - protein, 11 aa, Homo sapiens
VLKLQQVMQAK

SEQ ID NO: 27837 - protein, 11 aa, Homo sapiens
VLKLQQVMQAK

SEQ ID NO: 27838 - protein, 11 aa, Homo sapiens
VLKLQQVMQAK

SEQ ID NO: 27839 - protein, 11 aa, Homo sapiens
VLKLQQVMQAK

SEQ ID NO: 27840 - protein, 11 aa, Homo sapiens
VLKLQQVMQAK

SEQ ID NO: 27841 - protein, 11 aa, Homo sapiens
VLKLQQVMQAK

SEQ ID NO: 27842 - protein, 11 aa, Homo sapiens
YNVPNSAIYKR

SEQ ID NO: 27843 - protein, 11 aa, Homo sapiens
VLKLQQVMQAK

SEQ ID NO: 27844 - protein, 11 aa, Homo sapiens
YNVPNSAIYKR

SEQ ID NO: 27845 - protein, 11 aa, Homo sapiens
YNVPNSAIYKR

SEQ ID NO: 27846 - protein, 12 aa, Homo sapiens
RYNVPNSAIYKR

SEQ ID NO: 27847 - protein, 12 aa, Homo sapiens
RYNVPNSAIYKR

SEQ ID NO: 27848 - protein, 11 aa, Homo sapiens
YNVPNSAIYKR

SEQ ID NO: 27849 - protein, 11 aa, Homo sapiens
VLKLQQVMQAK

SEQ ID NO: 27850 - protein, 11 aa, Homo sapiens
VLKLQQVMQAK

SEQ ID NO: 27851 - protein, 11 aa, Homo sapiens
YNVPNSAIYKR

SEQ ID NO: 27852 - protein, 11 aa, Homo sapiens
VLKLQQVMQAK

SEQ ID NO: 27853 - protein, 11 aa, Homo sapiens
VLKLQQVMQAK

SEQ ID NO: 27854 - protein, 11 aa, Homo sapiens
VLKLQQVMQAK

SEQ ID NO: 27855 - protein, 11 aa, Homo sapiens
YNVPNSAIYKR

SEQ ID NO: 27856 - protein, 11 aa, Homo sapiens
YNVPNSAIYKR

SEQ ID NO: 27857 - protein, 11 aa, Homo sapiens
VLKLQQVMQAK

SEQ ID NO: 27858 - protein, 11 aa, Homo sapiens
VLKLQQVMQAK

SEQ ID NO: 27859 - protein, 15 aa, Homo sapiens
LNEVYEAVKNYTDKR

SEQ ID NO: 27860 - protein, 15 aa, Homo sapiens
LTGPSHSKGSLGEER

SEQ ID NO: 27861 - protein, 15 aa, Homo sapiens
LTGPSHSKGSLGEER

SEQ ID NO: 27862 - protein, 11 aa, Homo sapiens
VLKLQQVMQAK

SEQ ID NO: 27863 - protein, 15 aa, Homo sapiens
LTGPSHSKGSLGEER

SEQ ID NO: 27864 - protein, 15 aa, Homo sapiens
LTGPSHSKGSLGEER

SEQ ID NO: 27865 - protein, 15 aa, Homo sapiens
LTGPSHSKGSLGEER

SEQ ID NO: 27866 - protein, 15 aa, Homo sapiens
LTGPSHSKGSLGEER

SEQ ID NO: 27867 - protein, 15 aa, Homo sapiens
LTGPSHSKGSLGEER

SEQ ID NO: 27868 - protein, 8 aa, Homo sapiens
NPTSKYYR

SEQ ID NO: 27869 - protein, 15 aa, Homo sapiens
LTGPSHSKGSLGEER

SEQ ID NO: 27870 - protein, 15 aa, Homo sapiens
LTGPSHSKGSLGEER

SEQ ID NO: 27871 - protein, 15 aa, Homo sapiens
LTGPSHSKGSLGEER

SEQ ID NO: 27872 - protein, 15 aa, Homo sapiens
LTGPSHSKGSLGEER

SEQ ID NO: 27873 - protein, 15 aa, Homo sapiens
LTGPSHSKGSLGEER

SEQ ID NO: 27874 - protein, 15 aa, Homo sapiens
LTGPSHSKGSLGEER

SEQ ID NO: 27875 - protein, 17 aa, Homo sapiens
AVIKAQHPDYSFGELSR

SEQ ID NO: 27876 - protein, 17 aa, Homo sapiens
AVIKAQHPDYSFGELSR

SEQ ID NO: 27877 - protein, 17 aa, Homo sapiens
AVIKAQHPDYSFGELSR

SEQ ID NO: 27878 - protein, 17 aa, Homo sapiens
AVIKAQHPDYSFGELSR

SEQ ID NO: 27879 - protein, 17 aa, Homo sapiens
AVIKAQHPDYSFGELSR

SEQ ID NO: 27880 - protein, 17 aa, Homo sapiens
AVIKAQHPDYSFGELSR

SEQ ID NO: 27881 - protein, 17 aa, Homo sapiens
AVIKAQHPDYSFGELSR

SEQ ID NO: 27882 - protein, 17 aa, Homo sapiens
AVIKAQHPDYSFGELSR

SEQ ID NO: 27883 - protein, 17 aa, Homo sapiens
AVIKAQHPDYSFGELSR

SEQ ID NO: 27884 - protein, 17 aa, Homo sapiens
AVIKAQHPDYSFGELSR

SEQ ID NO: 27885 - protein, 17 aa, Homo sapiens
AVIKAQHPDYSFGELSR

SEQ ID NO: 27886 - protein, 17 aa, Homo sapiens
AVIKAQHPDYSFGELSR

SEQ ID NO: 27887 - protein, 17 aa, Homo sapiens
AVIKAQHPDYSFGELSR

SEQ ID NO: 27888 - protein, 17 aa, Homo sapiens
AVIKAQHPDYSFGELSR

SEQ ID NO: 27889 - protein, 11 aa, Homo sapiens
ELSQKTPPSMR

SEQ ID NO: 27890 - protein, 11 aa, Homo sapiens
ELSQKTPPSMR

SEQ ID NO: 27891 - protein, 11 aa, Homo sapiens
ELSQKTPPSMR

SEQ ID NO: 27892 - protein, 9 aa, Homo sapiens
KEKLPQVTR

SEQ ID NO: 27893 - protein, 9 aa, Homo sapiens
KEKLPQVTR

SEQ ID NO: 27894 - protein, 9 aa, Homo sapiens
KEKLPQVTR

SEQ ID NO: 27895 - protein, 9 aa, Homo sapiens
KEKLPQVTR

SEQ ID NO: 27896 - protein, 9 aa, Homo sapiens
EGSPANWKR

SEQ ID NO: 27897 - protein, 9 aa, Homo sapiens
EGSPANWKR

SEQ ID NO: 27898 - protein, 9 aa, Homo sapiens
KEKLPQVTR

SEQ ID NO: 27899 - protein, 9 aa, Homo sapiens
KEKLPQVTR

SEQ ID NO: 27900 - protein, 9 aa, Homo sapiens
EGSPANWKR

SEQ ID NO: 27901 - protein, 9 aa, Homo sapiens
KEKLPQVTR

SEQ ID NO: 27902 - protein, 16 aa, Homo sapiens
GKQGGPTYYIDTNALR

SEQ ID NO: 27903 - protein, 16 aa, Homo sapiens
GKQGGPTYYIDTNALR

SEQ ID NO: 27904 - protein, 13 aa, Homo sapiens
QEYEEGGKQCVER

SEQ ID NO: 27905 - protein, 13 aa, Homo sapiens
QEYEEGGKQCVER

SEQ ID NO: 27906 - protein, 13 aa, Homo sapiens
QEYEEGGKQCVER

SEQ ID NO: 27907 - protein, 20 aa, Homo sapiens
EKLTELMFEHYNIPAFFLCK

SEQ ID NO: 27908 - protein, 13 aa, Homo sapiens
QEYEEGGKQCVER

SEQ ID NO: 27909 - protein, 20 aa, Homo sapiens
EKLTELMFEHYNIPAFFLCK

SEQ ID NO: 27910 - protein, 20 aa, Homo sapiens
EKLTELMFEHYNIPAFFLCK

SEQ ID NO: 27911 - protein, 20 aa, Homo sapiens
EKLTELMFEHYNIPAFFLCK

SEQ ID NO: 27912 - protein, 13 aa, Homo sapiens
QEYEEGGKQCVER

SEQ ID NO: 27913 - protein, 20 aa, Homo sapiens
EKLTELMFEHYNIPAFFLCK

SEQ ID NO: 27914 - protein, 20 aa, Homo sapiens
EKLTELMFEHYNIPAFFLCK

SEQ ID NO: 27915 - protein, 20 aa, Homo sapiens
EKLTELMFEHYNIPAFFLCK

SEQ ID NO: 27916 - protein, 20 aa, Homo sapiens
EKLTELMFEHYNIPAFFLCK

SEQ ID NO: 27917 - protein, 10 aa, Homo sapiens
LDGTTKAEDR

SEQ ID NO: 27918 - protein, 11 aa, Homo sapiens
KELPEYYELIR

SEQ ID NO: 27919 - protein, 5 aa, Homo sapiens
IKLGR

SEQ ID NO: 27920 - protein, 8 aa, Homo sapiens
YKLNVDQK

SEQ ID NO: 27921 - protein, 8 aa, Homo sapiens
YKLNVDQK

SEQ ID NO: 27922 - protein, 5 aa, Homo sapiens
IEKER

SEQ ID NO: 27923 - protein, 5 aa, Homo sapiens
IEKER

SEQ ID NO: 27924 - protein, 5 aa, Homo sapiens
IEKER

SEQ ID NO: 27925 - protein, 5 aa, Homo sapiens
LKGGR

SEQ ID NO: 27926 - protein, 14 aa, Homo sapiens
LTKAVATYHANTER

SEQ ID NO: 27927 - protein, 14 aa, Homo sapiens
LTKAVATYHANTER

SEQ ID NO: 27928 - protein, 14 aa, Homo sapiens
LTKAVATYHANTER

SEQ ID NO: 27929 - protein, 11 aa, Homo sapiens
KELPEYYELIR

SEQ ID NO: 27930 - protein, 11 aa, Homo sapiens
KELPEYYELIR

SEQ ID NO: 27931 - protein, 11 aa, Homo sapiens
KELPEYYELIR

SEQ ID NO: 27932 - protein, 11 aa, Homo sapiens
KELPEYYELIR

SEQ ID NO: 27933 - protein, 10 aa, Homo sapiens
LDGTTKAEDR

SEQ ID NO: 27934 - protein, 11 aa, Homo sapiens
KELPEYYELIR

SEQ ID NO: 27935 - protein, 17 aa, Homo sapiens
GRPPAEKLSPNPPNLTK

SEQ ID NO: 27936 - protein, 17 aa, Homo sapiens
GRPPAEKLSPNPPNLTK

SEQ ID NO: 27937 - protein, 17 aa, Homo sapiens
GRPPAEKLSPNPPNLTK

SEQ ID NO: 27938 - protein, 17 aa, Homo sapiens
GRPPAEKLSPNPPNLTK

SEQ ID NO: 27939 - protein, 17 aa, Homo sapiens
GRPPAEKLSPNPPNLTK

SEQ ID NO: 27940 - protein, 17 aa, Homo sapiens
GRPPAEKLSPNPPNLTK

SEQ ID NO: 27941 - protein, 17 aa, Homo sapiens
GRPPAEKLSPNPPNLTK

SEQ ID NO: 27942 - protein, 17 aa, Homo sapiens
GRPPAEKLSPNPPNLTK

SEQ ID NO: 27943 - protein, 17 aa, Homo sapiens
GRPPAEKLSPNPPNLTK

SEQ ID NO: 27944 - protein, 6 aa, Homo sapiens
KPVDFK

SEQ ID NO: 27945 - protein, 5 aa, Homo sapiens
NHKYR

SEQ ID NO: 27946 - protein, 7 aa, Homo sapiens
KPVDFKK

SEQ ID NO: 27947 - protein, 7 aa, Homo sapiens
IRNHKYR

SEQ ID NO: 27948 - protein, 7 aa, Homo sapiens
IRNHKYR

SEQ ID NO: 27949 - protein, 6 aa, Homo sapiens
KPVDFK

SEQ ID NO: 27950 - protein, 6 aa, Homo sapiens
ILPKLR

SEQ ID NO: 27951 - protein, 10 aa, Homo sapiens
ASGKFELLDR

SEQ ID NO: 27952 - protein, 22 aa, Homo sapiens
HIIENAKQDVDDEYGVSQALAR

SEQ ID NO: 27953 - protein, 22 aa, Homo sapiens
HIIENAKQDVDDEYGVSQALAR

SEQ ID NO: 27954 - protein, 5 aa, Homo sapiens
LKGGR

SEQ ID NO: 27955 - protein, 5 aa, Homo sapiens
LKGGR

SEQ ID NO: 27956 - protein, 5 aa, Homo sapiens
LKGGR

SEQ ID NO: 27957 - protein, 5 aa, Homo sapiens
KENER

SEQ ID NO: 27958 - protein, 5 aa, Homo sapiens
KENER

SEQ ID NO: 27959 - protein, 5 aa, Homo sapiens
KENER

SEQ ID NO: 27960 - protein, 16 aa, Homo sapiens
KRDSDAGSSTPTTSTR

SEQ ID NO: 27961 - protein, 16 aa, Homo sapiens
KRDSDAGSSTPTTSTR

SEQ ID NO: 27962 - protein, 16 aa, Homo sapiens
KRDSDAGSSTPTTSTR

SEQ ID NO: 27963 - protein, 5 aa, Homo sapiens
KENER

SEQ ID NO: 27964 - protein, 15 aa, Homo sapiens
AVATYHANTEREQKK

SEQ ID NO: 27965 - protein, 5 aa, Homo sapiens
IEKER

SEQ ID NO: 27966 - protein, 5 aa, Homo sapiens
IEKER

SEQ ID NO: 27967 - protein, 8 aa, Homo sapiens
EQKKENER

SEQ ID NO: 27968 - protein, 8 aa, Homo sapiens
EQKKENER

SEQ ID NO: 27969 - protein, 5 aa, Homo sapiens
IEKER

SEQ ID NO: 27970 - protein, 8 aa, Homo sapiens
EQKKENER

SEQ ID NO: 27971 - protein, 9 aa, Homo sapiens
IKIIAPPER

SEQ ID NO: 27972 - protein, 9 aa, Homo sapiens
IKIIAPPER

SEQ ID NO: 27973 - protein, 9 aa, Homo sapiens
IKIIAPPER

SEQ ID NO: 27974 - protein, 9 aa, Homo sapiens
IKIIAPPER

SEQ ID NO: 27975 - protein, 9 aa, Homo sapiens
IKIIAPPER

SEQ ID NO: 27976 - protein, 13 aa, Homo sapiens
EITALAPSTMKIK

SEQ ID NO: 27977 - protein, 13 aa, Homo sapiens
EITALAPSTMKIK

SEQ ID NO: 27978 - protein, 13 aa, Homo sapiens
EITALAPSTMKIK

SEQ ID NO: 27979 - protein, 13 aa, Homo sapiens
EITALAPSTMKIK

SEQ ID NO: 27980 - protein, 13 aa, Homo sapiens
EITALAPSTMKIK

SEQ ID NO: 27981 - protein, 3 aa, Homo sapiens
KIR

SEQ ID NO: 27982 - protein, 3 aa, Homo sapiens
KIR

SEQ ID NO: 27983 - protein, 3 aa, Homo sapiens
KIR

SEQ ID NO: 27984 - protein, 3 aa, Homo sapiens
KIR

SEQ ID NO: 27985 - protein, 7 aa, Homo sapiens
KFSSFFK

SEQ ID NO: 27986 - protein, 8 aa, Homo sapiens
RKFSSFFK

SEQ ID NO: 27987 - protein, 9 aa, Homo sapiens
MKFSEIPQR

SEQ ID NO: 27988 - protein, 19 aa, Homo sapiens
KRPAPQQIQQVQQQAVQNR

SEQ ID NO: 27989 - protein, 7 aa, Homo sapiens
AKDDIKR

SEQ ID NO: 27990 - protein, 7 aa, Homo sapiens
AKDDIKR

SEQ ID NO: 27991 - protein, 7 aa, Homo sapiens
AKDDIKR

SEQ ID NO: 27992 - protein, 7 aa, Homo sapiens
AKDDIKR

SEQ ID NO: 27993 - protein, 7 aa, Homo sapiens
AKDDIKR

SEQ ID NO: 27994 - protein, 15 aa, Homo sapiens
KFLESTDSFNNELKR

SEQ ID NO: 27995 - protein, 15 aa, Homo sapiens
KFLESTDSFNNELKR

SEQ ID NO: 27996 - protein, 15 aa, Homo sapiens
KFLESTDSFNNELKR

SEQ ID NO: 27997 - protein, 15 aa, Homo sapiens
KFLESTDSFNNELKR

SEQ ID NO: 27998 - protein, 14 aa, Homo sapiens
KFLESTDSFNNELK

SEQ ID NO: 27999 - protein, 14 aa, Homo sapiens
KFLESTDSFNNELK

SEQ ID NO: 28000 - protein, 14 aa, Homo sapiens
KFLESTDSFNNELK

SEQ ID NO: 28001 - protein, 15 aa, Homo sapiens
KFLESTDSFNNELKR

SEQ ID NO: 28002 - protein, 10 aa, Homo sapiens
EKEAAEQAER

SEQ ID NO: 28003 - protein, 10 aa, Homo sapiens
EKEAAEQAER

SEQ ID NO: 28004 - protein, 10 aa, Homo sapiens
EKEAAEQAER

SEQ ID NO: 28005 - protein, 10 aa, Homo sapiens
EKEAAEQAER

SEQ ID NO: 28006 - protein, 10 aa, Homo sapiens
EKEAAEQAER

SEQ ID NO: 28007 - protein, 10 aa, Homo sapiens
EKEAAEQAER

SEQ ID NO: 28008 - protein, 10 aa, Homo sapiens
EKEAAEQAER

SEQ ID NO: 28009 - protein, 12 aa, Homo sapiens
LCGLKVEVDMEK

SEQ ID NO: 28010 - protein, 12 aa, Homo sapiens
LCGLKVEVDMEK

SEQ ID NO: 28011 - protein, 12 aa, Homo sapiens
LCGLKVEVDMEK

SEQ ID NO: 28012 - protein, 12 aa, Homo sapiens
LCGLKVEVDMEK

SEQ ID NO: 28013 - protein, 12 aa, Homo sapiens
LCGLKVEVDMEK

SEQ ID NO: 28014 - protein, 12 aa, Homo sapiens
LCGLKVEVDMEK

SEQ ID NO: 28015 - protein, 12 aa, Homo sapiens
LCGLKVEVDMEK

SEQ ID NO: 28016 - protein, 12 aa, Homo sapiens
LCGLKVEVDMEK

SEQ ID NO: 28017 - protein, 12 aa, Homo sapiens
LCGLKVEVDMEK

SEQ ID NO: 28018 - protein, 12 aa, Homo sapiens
LCGLKVEVDMEK

SEQ ID NO: 28019 - protein, 12 aa, Homo sapiens
LCGLKVEVDMEK

SEQ ID NO: 28020 - protein, 12 aa, Homo sapiens
LCGLKVEVDMEK

SEQ ID NO: 28021 - protein, 12 aa, Homo sapiens
LCGLKVEVDMEK

SEQ ID NO: 28022 - protein, 12 aa, Homo sapiens
LCGLKVEVDMEK

SEQ ID NO: 28023 - protein, 12 aa, Homo sapiens
LCGLKVEVDMEK

SEQ ID NO: 28024 - protein, 12 aa, Homo sapiens
LCGLKVEVDMEK

SEQ ID NO: 28025 - protein, 26 aa, Homo sapiens
LAGLLQHPDPIVINHVISVDPNDQKK

SEQ ID NO: 28026 - protein, 26 aa, Homo sapiens
LAGLLQHPDPIVINHVISVDPNDQKK

SEQ ID NO: 28027 - protein, 26 aa, Homo sapiens
LAGLLQHPDPIVINHVISVDPNDQKK

SEQ ID NO: 28028 - protein, 26 aa, Homo sapiens
LAGLLQHPDPIVINHVISVDPNDQKK

SEQ ID NO: 28029 - protein, 26 aa, Homo sapiens
LAGLLQHPDPIVINHVISVDPNDQKK

SEQ ID NO: 28030 - protein, 15 aa, Homo sapiens
VASAAAKAALEEFSR

SEQ ID NO: 28031 - protein, 15 aa, Homo sapiens
VASAAAKAALEEFSR

SEQ ID NO: 28032 - protein, 15 aa, Homo sapiens
VASAAAKAALEEFSR

SEQ ID NO: 28033 - protein, 15 aa, Homo sapiens
VASAAAKAALEEFSR

SEQ ID NO: 28034 - protein, 15 aa, Homo sapiens
VASAAAKAALEEFSR

SEQ ID NO: 28035 - protein, 15 aa, Homo sapiens
VASAAAKAALEEFSR

SEQ ID NO: 28036 - protein, 15 aa, Homo sapiens
VASAAAKAALEEFSR

SEQ ID NO: 28037 - protein, 15 aa, Homo sapiens
VASAAAKAALEEFSR

SEQ ID NO: 28038 - protein, 15 aa, Homo sapiens
VASAAAKAALEEFSR

SEQ ID NO: 28039 - protein, 15 aa, Homo sapiens
VASAAAKAALEEFSR

SEQ ID NO: 28040 - protein, 15 aa, Homo sapiens
VASAAAKAALEEFSR

SEQ ID NO: 28041 - protein, 15 aa, Homo sapiens
VASAAAKAALEEFSR

SEQ ID NO: 28042 - protein, 15 aa, Homo sapiens
VASAAAKAALEEFSR

SEQ ID NO: 28043 - protein, 15 aa, Homo sapiens
VASAAAKAALEEFSR

SEQ ID NO: 28044 - protein, 15 aa, Homo sapiens
VASAAAKAALEEFSR

SEQ ID NO: 28045 - protein, 15 aa, Homo sapiens
VASAAAKAALEEFSR

SEQ ID NO: 28046 - protein, 15 aa, Homo sapiens
VASAAAKAALEEFSR

SEQ ID NO: 28047 - protein, 15 aa, Homo sapiens
VASAAAKAALEEFSR

SEQ ID NO: 28048 - protein, 15 aa, Homo sapiens
VASAAAKAALEEFSR

SEQ ID NO: 28049 - protein, 15 aa, Homo sapiens
VASAAAKAALEEFSR

SEQ ID NO: 28050 - protein, 15 aa, Homo sapiens
VASAAAKAALEEFSR

SEQ ID NO: 28051 - protein, 15 aa, Homo sapiens
VASAAAKAALEEFSR

SEQ ID NO: 28052 - protein, 15 aa, Homo sapiens
VASAAAKAALEEFSR

SEQ ID NO: 28053 - protein, 15 aa, Homo sapiens
VASAAAKAALEEFSR

SEQ ID NO: 28054 - protein, 15 aa, Homo sapiens
VASAAAKAALEEFSR

SEQ ID NO: 28055 - protein, 15 aa, Homo sapiens
VASAAAKAALEEFSR

SEQ ID NO: 28056 - protein, 16 aa, Homo sapiens
VREEVPLELVEAHVKK

SEQ ID NO: 28057 - protein, 16 aa, Homo sapiens
VREEVPLELVEAHVKK

SEQ ID NO: 28058 - protein, 16 aa, Homo sapiens
VREEVPLELVEAHVKK

SEQ ID NO: 28059 - protein, 16 aa, Homo sapiens
VREEVPLELVEAHVKK

SEQ ID NO: 28060 - protein, 16 aa, Homo sapiens
VREEVPLELVEAHVKK

SEQ ID NO: 28061 - protein, 11 aa, Homo sapiens
HQGTFTDEKSK

SEQ ID NO: 28062 - protein, 10 aa, Homo sapiens
ISTKNEEPVR

SEQ ID NO: 28063 - protein, 14 aa, Homo sapiens
ISTKNEEPVRSPER

SEQ ID NO: 28064 - protein, 10 aa, Homo sapiens
ISTKNEEPVR

SEQ ID NO: 28065 - protein, 11 aa, Homo sapiens
ALPEFFNGKNK

SEQ ID NO: 28066 - protein, 9 aa, Homo sapiens
GQASLYGKR

SEQ ID NO: 28067 - protein, 13 aa, Homo sapiens
SQKEEDEQEDLTK

SEQ ID NO: 28068 - protein, 10 aa, Homo sapiens
AKHLAAVEER

SEQ ID NO: 28069 - protein, 10 aa, Homo sapiens
AKHLAAVEER

SEQ ID NO: 28070 - protein, 10 aa, Homo sapiens
AKHLAAVEER

SEQ ID NO: 28071 - protein, 10 aa, Homo sapiens
AKHLAAVEER

SEQ ID NO: 28072 - protein, 10 aa, Homo sapiens
AKHLAAVEER

SEQ ID NO: 28073 - protein, 10 aa, Homo sapiens
AKHLAAVEER

SEQ ID NO: 28074 - protein, 8 aa, Homo sapiens
SKGASAGR

SEQ ID NO: 28075 - protein, 7 aa, Homo sapiens
ESDTGKK

SEQ ID NO: 28076 - protein, 12 aa, Homo sapiens
EKPVDLQNFGLR

SEQ ID NO: 28077 - protein, 12 aa, Homo sapiens
EKPVDLQNFGLR

SEQ ID NO: 28078 - protein, 12 aa, Homo sapiens
EKPVDLQNFGLR

SEQ ID NO: 28079 - protein, 18 aa, Homo sapiens
SPQVPAAQQMLNFPEKNK

SEQ ID NO: 28080 - protein, 18 aa, Homo sapiens
SPQVPAAQQMLNFPEKNK

SEQ ID NO: 28081 - protein, 34 aa, Homo sapiens; identical to SEQ ID NO: 8864

SEQ ID NO: 28082 - protein, 10 aa, Homo sapiens
AKHLAAVEER

SEQ ID NO: 28083 - protein, 10 aa, Homo sapiens
AKHLAAVEER

SEQ ID NO: 28084 - protein, 10 aa, Homo sapiens
AKHLAAVEER

SEQ ID NO: 28085 - protein, 14 aa, Homo sapiens
ISTKNEEPVRSPER

SEQ ID NO: 28086 - protein, 14 aa, Homo sapiens
ISTKNEEPVRSPER

SEQ ID NO: 28087 - protein, 14 aa, Homo sapiens
ISTKNEEPVRSPER

SEQ ID NO: 28088 - protein, 14 aa, Homo sapiens
ISTKNEEPVRSPER

SEQ ID NO: 28089 - protein, 10 aa, Homo sapiens
ISTKNEEPVR

SEQ ID NO: 28090 - protein, 14 aa, Homo sapiens
ISTKNEEPVRSPER

SEQ ID NO: 28091 - protein, 10 aa, Homo sapiens
ISTKNEEPVR

SEQ ID NO: 28092 - protein, 4 aa, Homo sapiens
KVGR

SEQ ID NO: 28093 - protein, 20 aa, Homo sapiens
TKVSSYPVALIPGQFQEYYK

SEQ ID NO: 28094 - protein, 20 aa, Homo sapiens
TKVSSYPVALIPGQFQEYYK

SEQ ID NO: 28095 - protein, 21 aa, Homo sapiens
TKVSSYPVALIPGQFQEYYKR

SEQ ID NO: 28096 - protein, 8 aa, Homo sapiens
YKVLPTER

SEQ ID NO: 28097 - protein, 20 aa, Homo sapiens
TKVSSYPVALIPGQFQEYYK

SEQ ID NO: 28098 - protein, 21 aa, Homo sapiens
TKVSSYPVALIPGQFQEYYKR

SEQ ID NO: 28099 - protein, 20 aa, Homo sapiens
TKVSSYPVALIPGQFQEYYK

SEQ ID NO: 28100 - protein, 20 aa, Homo sapiens
TKVSSYPVALIPGQFQEYYK

SEQ ID NO: 28101 - protein, 8 aa, Homo sapiens
YKVLPTER

SEQ ID NO: 28102 - protein, 8 aa, Homo sapiens
YKVLPTER

SEQ ID NO: 28103 - protein, 21 aa, Homo sapiens
TKVSSYPVALIPGQFQEYYKR

SEQ ID NO: 28104 - protein, 13 aa, Homo sapiens
SVLSKSVPGYKPK

SEQ ID NO: 28105 - protein, 6 aa, Homo sapiens
GKESNK

SEQ ID NO: 28106 - protein, 29 aa, Homo sapiens
NKGTSDSSSGNVSEGESPPDSQEDSFQGR

SEQ ID NO: 28107 - protein, 6 aa, Homo sapiens
KDGPKR

SEQ ID NO: 28108 - protein, 13 aa, Homo sapiens
SVLSKSVPGYKPK

SEQ ID NO: 28109 - protein, 4 aa, Homo sapiens
KVGR

SEQ ID NO: 28110 - protein, 4 aa, Homo sapiens
KVGR

SEQ ID NO: 28111 - protein, 4 aa, Homo sapiens
KVGR

SEQ ID NO: 28112 - protein, 13 aa, Homo sapiens
HAEYSVILQEKER

SEQ ID NO: 28113 - protein, 13 aa, Homo sapiens
HAEYSVILQEKER

SEQ ID NO: 28114 - protein, 6 aa, Homo sapiens
KDGPKR

SEQ ID NO: 28115 - protein, 7 aa, Homo sapiens
KYPDLER

SEQ ID NO: 28116 - protein, 8 aa, Homo sapiens
RKYPDLER

SEQ ID NO: 28117 - protein, 7 aa, Homo sapiens
KYPDLER

SEQ ID NO: 28118 - protein, 7 aa, Homo sapiens
KYPDLER

SEQ ID NO: 28119 - protein, 11 aa, Homo sapiens
DLSHKEKLYLR

SEQ ID NO: 28120 - protein, 7 aa, Homo sapiens
DLSHKEK

SEQ ID NO: 28121 - protein, 8 aa, Homo sapiens
RDLSHKEK

SEQ ID NO: 28122 - protein, 8 aa, Homo sapiens
KYPDLERR

SEQ ID NO: 28123 - protein, 8 aa, Homo sapiens
KYPDLERR

SEQ ID NO: 28124 - protein, 8 aa, Homo sapiens
KYPDLERR

SEQ ID NO: 28125 - protein, 4 aa, Homo sapiens
KVGR

SEQ ID NO: 28126 - protein, 4 aa, Homo sapiens
KVGR

SEQ ID NO: 28127 - protein, 7 aa, Homo sapiens
KYPDLER

SEQ ID NO: 28128 - protein, 7 aa, Homo sapiens
KYPDLER

SEQ ID NO: 28129 - protein, 8 aa, Homo sapiens
RKYPDLER

SEQ ID NO: 28130 - protein, 7 aa, Homo sapiens
KYPDLER

SEQ ID NO: 28131 - protein, 7 aa, Homo sapiens
KYPDLER

SEQ ID NO: 28132 - protein, 8 aa, Homo sapiens
KYPDLERR

SEQ ID NO: 28133 - protein, 7 aa, Homo sapiens
KYPDLER

SEQ ID NO: 28134 - protein, 7 aa, Homo sapiens
KYPDLER

SEQ ID NO: 28135 - protein, 7 aa, Homo sapiens
KYPDLER

SEQ ID NO: 28136 - protein, 7 aa, Homo sapiens
KYPDLER

SEQ ID NO: 28137 - protein, 7 aa, Homo sapiens
KYPDLER

SEQ ID NO: 28138 - protein, 7 aa, Homo sapiens
KYPDLER

SEQ ID NO: 28139 - protein, 7 aa, Homo sapiens
KYPDLER

SEQ ID NO: 28140 - protein, 7 aa, Homo sapiens
KYPDLER

SEQ ID NO: 28141 - protein, 7 aa, Homo sapiens
KYPDLER

SEQ ID NO: 28142 - protein, 15 aa, Homo sapiens
SDEVIDLMIKEYPAK

SEQ ID NO: 28143 - protein, 15 aa, Homo sapiens
SDEVIDLMIKEYPAK

SEQ ID NO: 28144 - protein, 7 aa, Homo sapiens
KYPDLER

SEQ ID NO: 28145 - protein, 13 aa, Homo sapiens
HAEYSVILQEKER

SEQ ID NO: 28146 - protein, 13 aa, Homo sapiens
HAEYSVILQEKER

SEQ ID NO: 28147 - protein, 13 aa, Homo sapiens
HAEYSVILQEKER

SEQ ID NO: 28148 - protein, 18 aa, Homo sapiens
EYPAKHAEYSVILQEKER

SEQ ID NO: 28149 - protein, 7 aa, Homo sapiens
KYPDLER

SEQ ID NO: 28150 - protein, 7 aa, Homo sapiens
KYPDLER

SEQ ID NO: 28151 - protein, 16 aa, Homo sapiens
EYPAKHAEYSVILQEK

SEQ ID NO: 28152 - protein, 16 aa, Homo sapiens
EYPAKHAEYSVILQEK

SEQ ID NO: 28153 - protein, 16 aa, Homo sapiens
EYPAKHAEYSVILQEK

SEQ ID NO: 28154 - protein, 16 aa, Homo sapiens
EYPAKHAEYSVILQEK

SEQ ID NO: 28155 - protein, 16 aa, Homo sapiens
EYPAKHAEYSVILQEK

SEQ ID NO: 28156 - protein, 7 aa, Homo sapiens
KYPDLER

SEQ ID NO: 28157 - protein, 16 aa, Homo sapiens
EYPAKHAEYSVILQEK

SEQ ID NO: 28158 - protein, 16 aa, Homo sapiens
EYPAKHAEYSVILQEK

SEQ ID NO: 28159 - protein, 7 aa, Homo sapiens
KYPDLER

SEQ ID NO: 28160 - protein, 7 aa, Homo sapiens
KYPDLER

SEQ ID NO: 28161 - protein, 7 aa, Homo sapiens
KYPDLER

SEQ ID NO: 28162 - protein, 16 aa, Homo sapiens
EYPAKHAEYSVILQEK

SEQ ID NO: 28163 - protein, 7 aa, Homo sapiens
KYPDLER

SEQ ID NO: 28164 - protein, 7 aa, Homo sapiens
KYPDLER

SEQ ID NO: 28165 - protein, 7 aa, Homo sapiens
KYPDLER

SEQ ID NO: 28166 - protein, 16 aa, Homo sapiens
EYPAKHAEYSVILQEK

SEQ ID NO: 28167 - protein, 7 aa, Homo sapiens
KYPDLER

SEQ ID NO: 28168 - protein, 16 aa, Homo sapiens
EYPAKHAEYSVILQEK

SEQ ID NO: 28169 - protein, 7 aa, Homo sapiens
KYPDLER

SEQ ID NO: 28170 - protein, 7 aa, Homo sapiens
KYPDLER

SEQ ID NO: 28171 - protein, 8 aa, Homo sapiens
RKYPDLER

SEQ ID NO: 28172 - protein, 7 aa, Homo sapiens
KYPDLER

SEQ ID NO: 28173 - protein, 16 aa, Homo sapiens
EYPAKHAEYSVILQEK

SEQ ID NO: 28174 - protein, 16 aa, Homo sapiens
EYPAKHAEYSVILQEK

SEQ ID NO: 28175 - protein, 16 aa, Homo sapiens
EYPAKHAEYSVILQEK

SEQ ID NO: 28176 - protein, 7 aa, Homo sapiens
KYPDLER

SEQ ID NO: 28177 - protein, 7 aa, Homo sapiens
KYPDLER

SEQ ID NO: 28178 - protein, 16 aa, Homo sapiens
EYPAKHAEYSVILQEK

SEQ ID NO: 28179 - protein, 16 aa, Homo sapiens
EYPAKHAEYSVILQEK

SEQ ID NO: 28180 - protein, 16 aa, Homo sapiens
EYPAKHAEYSVILQEK

SEQ ID NO: 28181 - protein, 7 aa, Homo sapiens
KYPDLER

SEQ ID NO: 28182 - protein, 16 aa, Homo sapiens
EYPAKHAEYSVILQEK

SEQ ID NO: 28183 - protein, 16 aa, Homo sapiens
EYPAKHAEYSVILQEK

SEQ ID NO: 28184 - protein, 16 aa, Homo sapiens
EYPAKHAEYSVILQEK

SEQ ID NO: 28185 - protein, 16 aa, Homo sapiens
EYPAKHAEYSVILQEK

SEQ ID NO: 28186 - protein, 16 aa, Homo sapiens
EYPAKHAEYSVILQEK

SEQ ID NO: 28187 - protein, 16 aa, Homo sapiens
EYPAKHAEYSVILQEK

SEQ ID NO: 28188 - protein, 16 aa, Homo sapiens
EYPAKHAEYSVILQEK

SEQ ID NO: 28189 - protein, 16 aa, Homo sapiens
EYPAKHAEYSVILQEK

SEQ ID NO: 28190 - protein, 7 aa, Homo sapiens
KYPDLER

SEQ ID NO: 28191 - protein, 16 aa, Homo sapiens
EYPAKHAEYSVILQEK

SEQ ID NO: 28192 - protein, 16 aa, Homo sapiens
EYPAKHAEYSVILQEK

SEQ ID NO: 28193 - protein, 16 aa, Homo sapiens
EYPAKHAEYSVILQEK

SEQ ID NO: 28194 - protein, 16 aa, Homo sapiens
EYPAKHAEYSVILQEK

SEQ ID NO: 28195 - protein, 18 aa, Homo sapiens
EYPAKHAEYSVILQEKER

SEQ ID NO: 28196 - protein, 16 aa, Homo sapiens
EYPAKHAEYSVILQEK

SEQ ID NO: 28197 - protein, 16 aa, Homo sapiens
EYPAKHAEYSVILQEK

SEQ ID NO: 28198 - protein, 16 aa, Homo sapiens
EYPAKHAEYSVILQEK

SEQ ID NO: 28199 - protein, 18 aa, Homo sapiens
EYPAKHAEYSVILQEKER

SEQ ID NO: 28200 - protein, 16 aa, Homo sapiens
EYPAKHAEYSVILQEK

SEQ ID NO: 28201 - protein, 16 aa, Homo sapiens
EYPAKHAEYSVILQEK

SEQ ID NO: 28202 - protein, 18 aa, Homo sapiens
EYPAKHAEYSVILQEKER

SEQ ID NO: 28203 - protein, 16 aa, Homo sapiens
EYPAKHAEYSVILQEK

SEQ ID NO: 28204 - protein, 18 aa, Homo sapiens
EYPAKHAEYSVILQEKER

SEQ ID NO: 28205 - protein, 16 aa, Homo sapiens
EYPAKHAEYSVILQEK

SEQ ID NO: 28206 - protein, 18 aa, Homo sapiens
EYPAKHAEYSVILQEKER

SEQ ID NO: 28207 - protein, 16 aa, Homo sapiens
EYPAKHAEYSVILQEK

SEQ ID NO: 28208 - protein, 16 aa, Homo sapiens
EYPAKHAEYSVILQEK

SEQ ID NO: 28209 - protein, 16 aa, Homo sapiens
EYPAKHAEYSVILQEK

SEQ ID NO: 28210 - protein, 16 aa, Homo sapiens
EYPAKHAEYSVILQEK

SEQ ID NO: 28211 - protein, 21 aa, Homo sapiens
TKVSSYPVALIPGQFQEYYKR

SEQ ID NO: 28212 - protein, 5 aa, Homo sapiens
KAAKK

SEQ ID NO: 28213 - protein, 11 aa, Homo sapiens
KAAEFNSNLNR

SEQ ID NO: 28214 - protein, 11 aa, Homo sapiens
KAAEFNSNLNR

SEQ ID NO: 28215 - protein, 4 aa, Homo sapiens
KAAK

SEQ ID NO: 28216 - protein, 13 aa, Homo sapiens
HAEYSVILQEKER

SEQ ID NO: 28217 - protein, 7 aa, Homo sapiens
DKAATPR

SEQ ID NO: 28218 - protein, 13 aa, Homo sapiens
HAEYSVILQEKER

SEQ ID NO: 28219 - protein, 13 aa, Homo sapiens
HAEYSVILQEKER

SEQ ID NO: 28220 - protein, 13 aa, Homo sapiens
HAEYSVILQEKER

SEQ ID NO: 28221 - protein, 13 aa, Homo sapiens
HAEYSVILQEKER

SEQ ID NO: 28222 - protein, 13 aa, Homo sapiens
HAEYSVILQEKER

SEQ ID NO: 28223 - protein, 13 aa, Homo sapiens
HAEYSVILQEKER

SEQ ID NO: 28224 - protein, 4 aa, Homo sapiens
KVGR

SEQ ID NO: 28225 - protein, 4 aa, Homo sapiens
KVGR

SEQ ID NO: 28226 - protein, 13 aa, Homo sapiens
HAEYSVILQEKER

SEQ ID NO: 28227 - protein, 13 aa, Homo sapiens
HAEYSVILQEKER

SEQ ID NO: 28228 - protein, 9 aa, Homo sapiens
SKDKAATPR

SEQ ID NO: 28229 - protein, 5 aa, Homo sapiens
KDGPK

SEQ ID NO: 28230 - protein, 10 aa, Homo sapiens
REQKKETERI

SEQ ID NO: 28231 - protein, 7 aa, Homo sapiens
RNHKYRS

SEQ ID NO: 28232 - protein, 7 aa, Homo sapiens
RNHKYRS

SEQ ID NO: 28233 - protein, 7 aa, Homo sapiens
RNHKYRS

SEQ ID NO: 28234 - protein, 10 aa, Homo sapiens
REQKKETERI

SEQ ID NO: 28235 - protein, 13 aa, Homo sapiens
RVEGKLLDDPSKQ

SEQ ID NO: 28236 - protein, 12 aa, Homo sapiens
RKGLAFLDELRQ

SEQ ID NO: 28237 - protein, 12 aa, Homo sapiens
RKGLAFLDELRQ

SEQ ID NO: 28238 - protein, 12 aa, Homo sapiens
RKGLAFLDELRQ

SEQ ID NO: 28239 - protein, 19 aa, Homo sapiens
RAQKAIVNHPSAALMALRR

SEQ ID NO: 28240 - protein, 19 aa, Homo sapiens
RAQKAIVNHPSAALMALRR

SEQ ID NO: 28241 - protein, 19 aa, Homo sapiens
RAQKAIVNHPSAALMALRR

SEQ ID NO: 28242 - protein, 19 aa, Homo sapiens
RAQKAIVNHPSAALMALRR

SEQ ID NO: 28243 - protein, 12 aa, Homo sapiens
RTVFPNHTVKRV

SEQ ID NO: 28244 - protein, 12 aa, Homo sapiens
RTVFPNHTVKRV

SEQ ID NO: 28245 - protein, 12 aa, Homo sapiens
RTVFPNHTVKRV

SEQ ID NO: 28246 - protein, 17 aa, Homo sapiens
KEEEAKEATGLHVHERK

SEQ ID NO: 28247 - protein, 17 aa, Homo sapiens
KEEEAKEATGLHVHERK

SEQ ID NO: 28248 - protein, 17 aa, Homo sapiens
KEEEAKEATGLHVHERK

SEQ ID NO: 28249 - protein, 43 aa, Homo sapiens; identical to SEQ ID NO: 26283

SEQ ID NO: 28250 - protein, 15 aa, Homo sapiens
RVTTLGGFAKVSEKN

SEQ ID NO: 28251 - protein, 10 aa, Homo sapiens
KFKSNNLERE

SEQ ID NO: 28252 - protein, 10 aa, Homo sapiens
KFKSNNLERE

SEQ ID NO: 28253 - protein, 10 aa, Homo sapiens
RIVKESGGKL

SEQ ID NO: 28254 - protein, 10 aa, Homo sapiens
RIVKESGGKL

SEQ ID NO: 28255 - protein, 22 aa, Homo sapiens
KEPKEGQEEVLKEVVESEGERK

SEQ ID NO: 28256 - protein, 22 aa, Homo sapiens
KEPKEGQEEVLKEVVESEGERK

SEQ ID NO: 28257 - protein, 13 aa, Homo sapiens
KEPKEGQEEVLKE

SEQ ID NO: 28258 - protein, 13 aa, Homo sapiens
KEPKEGQEEVLKE

SEQ ID NO: 28259 - protein, 9 aa, Homo sapiens
KKEPKEPRE

SEQ ID NO: 28260 - protein, 9 aa, Homo sapiens
KKEPKEPRE

SEQ ID NO: 28261 - protein, 9 aa, Homo sapiens
KKEPKEPRE

SEQ ID NO: 28262 - protein, 10 aa, Homo sapiens
KEKTSEAPKK

SEQ ID NO: 28263 - protein, 10 aa, Homo sapiens
KEKTSEAPKK

SEQ ID NO: 28264 - protein, 10 aa, Homo sapiens
KGKEGDSEKE

SEQ ID NO: 28265 - protein, 10 aa, Homo sapiens
KGKEGDSEKE

SEQ ID NO: 28266 - protein, 7 aa, Homo sapiens
KKDEEKG

SEQ ID NO: 28267 - protein, 7 aa, Homo sapiens
KKDEEKG

SEQ ID NO: 28268 - protein, 9 aa, Homo sapiens
KKDEEKGKE

SEQ ID NO: 28269 - protein, 9 aa, Homo sapiens
KKDEEKGKE

SEQ ID NO: 28270 - protein, 7 aa, Homo sapiens
KKDEEKG

SEQ ID NO: 28271 - protein, 7 aa, Homo sapiens
KKDEEKG

SEQ ID NO: 28272 - protein, 9 aa, Homo sapiens
KKDEEKGKE

SEQ ID NO: 28273 - protein, 9 aa, Homo sapiens
KKDEEKGKE

SEQ ID NO: 28274 - protein, 9 aa, Homo sapiens
KKDEEKGKE

SEQ ID NO: 28275 - protein, 9 aa, Homo sapiens
KKDEEKGKE

SEQ ID NO: 28276 - protein, 7 aa, Homo sapiens
KEKEPKE

SEQ ID NO: 28277 - protein, 7 aa, Homo sapiens
KEKEPKE

SEQ ID NO: 28278 - protein, 11 aa, Homo sapiens
RKKDGGPNVKY

SEQ ID NO: 28279 - protein, 11 aa, Homo sapiens
RKKDGGPNVKY

SEQ ID NO: 28280 - protein, 11 aa, Homo sapiens
RKKDGGPNVKY

SEQ ID NO: 28281 - protein, 11 aa, Homo sapiens
RKKDGGPNVKY

SEQ ID NO: 28282 - protein, 11 aa, Homo sapiens
RKKDGGPNVKY

SEQ ID NO: 28283 - protein, 21 aa, Homo sapiens
KTPQQTSASQQMLNFPDKGKE

SEQ ID NO: 28284 - protein, 13 aa, Homo sapiens
KTSEAPKKDEEKG

SEQ ID NO: 28285 - protein, 13 aa, Homo sapiens
KTSEAPKKDEEKG

SEQ ID NO: 28286 - protein, 9 aa, Homo sapiens
KKDEEKGKE

SEQ ID NO: 28287 - protein, 13 aa, Homo sapiens
KTSEAPKKDEEKG

SEQ ID NO: 28288 - protein, 9 aa, Homo sapiens
KKDEEKGKE

SEQ ID NO: 28289 - protein, 7 aa, Homo sapiens
KKDEEKG

SEQ ID NO: 28290 - protein, 7 aa, Homo sapiens
KKDEEKG

SEQ ID NO: 28291 - protein, 7 aa, Homo sapiens
KKDEEKG

SEQ ID NO: 28292 - protein, 13 aa, Homo sapiens
KTSEAPKKDEEKG

SEQ ID NO: 28293 - protein, 13 aa, Homo sapiens
KTSEAPKKDEEKG

SEQ ID NO: 28294 - protein, 9 aa, Homo sapiens
RKVEEAAKV

SEQ ID NO: 28295 - protein, 9 aa, Homo sapiens
RKVEEAAKV

SEQ ID NO: 28296 - protein, 9 aa, Homo sapiens
RKVEEAAKV

SEQ ID NO: 28297 - protein, 9 aa, Homo sapiens
RKVEEAAKV

SEQ ID NO: 28298 - protein, 9 aa, Homo sapiens
RKVEEAAKV

SEQ ID NO: 28299 - protein, 9 aa, Homo sapiens
RKVEEAAKV

SEQ ID NO: 28300 - protein, 9 aa, Homo sapiens
RKVEEAAKV

SEQ ID NO: 28301 - protein, 9 aa, Homo sapiens
RKVEEAAKV

SEQ ID NO: 28302 - protein, 9 aa, Homo sapiens
RKVEEAAKV

SEQ ID NO: 28303 - protein, 9 aa, Homo sapiens
RKVEEAAKV

SEQ ID NO: 28304 - protein, 9 aa, Homo sapiens
RKVEEAAKV

SEQ ID NO: 28305 - protein, 9 aa, Homo sapiens
RKVEEAAKV

SEQ ID NO: 28306 - protein, 8 aa, Homo sapiens
RKTKVERD

SEQ ID NO: 28307 - protein, 8 aa, Homo sapiens
RKTKVERD

SEQ ID NO: 28308 - protein, 9 aa, Homo sapiens
RKVEEAAKV

SEQ ID NO: 28309 - protein, 14 aa, Homo sapiens
KGKEGDSEKESEKS

SEQ ID NO: 28310 - protein, 14 aa, Homo sapiens
KGKEGDSEKESEKS

SEQ ID NO: 28311 - protein, 14 aa, Homo sapiens
KGKEGDSEKESEKS

SEQ ID NO: 28312 - protein, 10 aa, Homo sapiens
KGKEGDSEKE

SEQ ID NO: 28313 - protein, 10 aa, Homo sapiens
KGKEGDSEKE

SEQ ID NO: 28314 - protein, 10 aa, Homo sapiens
KGKEGDSEKE

SEQ ID NO: 28315 - protein, 19 aa, Homo sapiens
KEGQEEVLKEVVESEGERK

SEQ ID NO: 28316 - protein, 19 aa, Homo sapiens
KEGQEEVLKEVVESEGERK

SEQ ID NO: 28317 - protein, 19 aa, Homo sapiens
KEGQEEVLKEVVESEGERK

SEQ ID NO: 28318 - protein, 19 aa, Homo sapiens
KEGQEEVLKEVVESEGERK

SEQ ID NO: 28319 - protein, 8 aa, Homo sapiens
RKTKVERD

SEQ ID NO: 28320 - protein, 19 aa, Homo sapiens
KEGQEEVLKEVVESEGERK

SEQ ID NO: 28321 - protein, 19 aa, Homo sapiens
KEGQEEVLKEVVESEGERK

SEQ ID NO: 28322 - protein, 19 aa, Homo sapiens
KEGQEEVLKEVVESEGERK

SEQ ID NO: 28323 - protein, 19 aa, Homo sapiens
KEGQEEVLKEVVESEGERK

SEQ ID NO: 28324 - protein, 8 aa, Homo sapiens
RKTKVERD

SEQ ID NO: 28325 - protein, 8 aa, Homo sapiens
RKTKVERD

SEQ ID NO: 28326 - protein, 8 aa, Homo sapiens
RKTKVERD

SEQ ID NO: 28327 - protein, 8 aa, Homo sapiens
RKTKVERD

SEQ ID NO: 28328 - protein, 8 aa, Homo sapiens
RKTKVERD

SEQ ID NO: 28329 - protein, 7 aa, Homo sapiens
KTKVERD

SEQ ID NO: 28330 - protein, 8 aa, Homo sapiens
RKTKVERD

SEQ ID NO: 28331 - protein, 8 aa, Homo sapiens
RKTKVERD

SEQ ID NO: 28332 - protein, 8 aa, Homo sapiens
RKTKVERD

SEQ ID NO: 28333 - protein, 8 aa, Homo sapiens
RKTKVERD

SEQ ID NO: 28334 - protein, 8 aa, Homo sapiens
RKTKVERD

SEQ ID NO: 28335 - protein, 8 aa, Homo sapiens
RKTKVERD

SEQ ID NO: 28336 - protein, 7 aa, Homo sapiens
KTKVERD

SEQ ID NO: 28337 - protein, 8 aa, Homo sapiens
RKTKVERD

SEQ ID NO: 28338 - protein, 8 aa, Homo sapiens
RKTKVERD

SEQ ID NO: 28339 - protein, 8 aa, Homo sapiens
RKTKVERD

SEQ ID NO: 28340 - protein, 8 aa, Homo sapiens
RKTKVERD

SEQ ID NO: 28341 - protein, 17 aa, Homo sapiens
KMKEEVPTALVEAHVRK

SEQ ID NO: 28342 - protein, 9 aa, Homo sapiens
RKVEEAAKV

SEQ ID NO: 28343 - protein, 9 aa, Homo sapiens
RKVEEAAKV

SEQ ID NO: 28344 - protein, 17 aa, Homo sapiens
KMKEEVPTALVEAHVRK

SEQ ID NO: 28345 - protein, 17 aa, Homo sapiens
KMKEEVPTALVEAHVRK

SEQ ID NO: 28346 - protein, 7 aa, Homo sapiens
KTKVERD

SEQ ID NO: 28347 - protein, 17 aa, Homo sapiens
KMKEEVPTALVEAHVRK

SEQ ID NO: 28348 - protein, 12 aa, Homo sapiens
KAKHLAAVEERK

SEQ ID NO: 28349 - protein, 12 aa, Homo sapiens
KAKHLAAVEERK

SEQ ID NO: 28350 - protein, 12 aa, Homo sapiens
KAKHLAAVEERK

SEQ ID NO: 28351 - protein, 17 aa, Homo sapiens
KMKEEVPTALVEAHVRK

SEQ ID NO: 28352 - protein, 17 aa, Homo sapiens
KMKEEVPTALVEAHVRK

SEQ ID NO: 28353 - protein, 17 aa, Homo sapiens
KMKEEVPTALVEAHVRK

SEQ ID NO: 28354 - protein, 17 aa, Homo sapiens
KMKEEVPTALVEAHVRK

SEQ ID NO: 28355 - protein, 17 aa, Homo sapiens
KMKEEVPTALVEAHVRK

SEQ ID NO: 28356 - protein, 17 aa, Homo sapiens
KMKEEVPTALVEAHVRK

SEQ ID NO: 28357 - protein, 12 aa, Homo sapiens
KAKHLAAVEERK

SEQ ID NO: 28358 - protein, 12 aa, Homo sapiens
KAKHLAAVEERK

SEQ ID NO: 28359 - protein, 17 aa, Homo sapiens
KMKEEVPTALVEAHVRK

SEQ ID NO: 28360 - protein, 12 aa, Homo sapiens
KAKHLAAVEERK

SEQ ID NO: 28361 - protein, 17 aa, Homo sapiens
KMKEEVPTALVEAHVRK

SEQ ID NO: 28362 - protein, 17 aa, Homo sapiens
KMKEEVPTALVEAHVRK

SEQ ID NO: 28363 - protein, 17 aa, Homo sapiens
KMKEEVPTALVEAHVRK

SEQ ID NO: 28364 - protein, 17 aa, Homo sapiens
KMKEEVPTALVEAHVRK

SEQ ID NO: 28365 - protein, 17 aa, Homo sapiens
KMKEEVPTALVEAHVRK

SEQ ID NO: 28366 - protein, 17 aa, Homo sapiens
KMKEEVPTALVEAHVRK

SEQ ID NO: 28367 - protein, 17 aa, Homo sapiens
KMKEEVPTALVEAHVRK

SEQ ID NO: 28368 - protein, 17 aa, Homo sapiens
KMKEEVPTALVEAHVRK

SEQ ID NO: 28369 - protein, 17 aa, Homo sapiens
KMKEEVPTALVEAHVRK

SEQ ID NO: 28370 - protein, 17 aa, Homo sapiens
KMKEEVPTALVEAHVRK

SEQ ID NO: 28371 - protein, 12 aa, Homo sapiens
KAKHLAAVEERK

SEQ ID NO: 28372 - protein, 12 aa, Homo sapiens
KAKHLAAVEERK

SEQ ID NO: 28373 - protein, 12 aa, Homo sapiens
KAKHLAAVEERK

SEQ ID NO: 28374 - protein, 12 aa, Homo sapiens
KAKHLAAVEERK

SEQ ID NO: 28375 - protein, 12 aa, Homo sapiens
KAKHLAAVEERK

SEQ ID NO: 28376 - protein, 12 aa, Homo sapiens
KAKHLAAVEERK

SEQ ID NO: 28377 - protein, 12 aa, Homo sapiens
KAKHLAAVEERK

SEQ ID NO: 28378 - protein, 17 aa, Homo sapiens
RVASAAAKSALEEFSKM

SEQ ID NO: 28379 - protein, 9 aa, Homo sapiens
RKVEEAAKV

SEQ ID NO: 28380 - protein, 8 aa, Homo sapiens
RKTKVERD

SEQ ID NO: 28381 - protein, 7 aa, Homo sapiens
KTKVERD

SEQ ID NO: 28382 - protein, 8 aa, Homo sapiens
RKTKVERD

SEQ ID NO: 28383 - protein, 7 aa, Homo sapiens
KTKVERD

SEQ ID NO: 28384 - protein, 15 aa, Homo sapiens
REGGGAIEEEAKEKT

SEQ ID NO: 28385 - protein, 8 aa, Homo sapiens
KEPKEPRE

SEQ ID NO: 28386 - protein, 8 aa, Homo sapiens
KEPKEPRE

SEQ ID NO: 28387 - protein, 8 aa, Homo sapiens
KEPKEPRE

SEQ ID NO: 28388 - protein, 8 aa, Homo sapiens
KEPKEPRE

SEQ ID NO: 28389 - protein, 12 aa, Homo sapiens
RVEGQATDEKKE

SEQ ID NO: 28390 - protein, 8 aa, Homo sapiens
KEPKEPRE

SEQ ID NO: 28391 - protein, 12 aa, Homo sapiens
RVEGQATDEKKE

SEQ ID NO: 28392 - protein, 12 aa, Homo sapiens
RVEGQATDEKKE

SEQ ID NO: 28393 - protein, 12 aa, Homo sapiens
RVEGQATDEKKE

SEQ ID NO: 28394 - protein, 12 aa, Homo sapiens
RVEGQATDEKKE

SEQ ID NO: 28395 - protein, 12 aa, Homo sapiens
RVEGQATDEKKE

SEQ ID NO: 28396 - protein, 12 aa, Homo sapiens
RVEGQATDEKKE

SEQ ID NO: 28397 - protein, 8 aa, Homo sapiens
KEPKEPRE

SEQ ID NO: 28398 - protein, 12 aa, Homo sapiens
RVEGQATDEKKE

SEQ ID NO: 28399 - protein, 8 aa, Homo sapiens
KEPKEPRE

SEQ ID NO: 28400 - protein, 12 aa, Homo sapiens
RVEGQATDEKKE

SEQ ID NO: 28401 - protein, 8 aa, Homo sapiens
KEPKEPRE

SEQ ID NO: 28402 - protein, 7 aa, Homo sapiens
KTKVERD

SEQ ID NO: 28403 - protein, 8 aa, Homo sapiens
KKNVPSKS

SEQ ID NO: 28404 - protein, 8 aa, Homo sapiens
KKNVPSKS

SEQ ID NO: 28405 - protein, 7 aa, Homo sapiens
KTKVERD

SEQ ID NO: 28406 - protein, 8 aa, Homo sapiens
RKTKVERD

SEQ ID NO: 28407 - protein, 8 aa, Homo sapiens
KNYTDKRG

SEQ ID NO: 28408 - protein, 15 aa, Homo sapiens
KDALVLHKVLLETRR

SEQ ID NO: 28409 - protein, 8 aa, Homo sapiens
KNYTDKRG

SEQ ID NO: 28410 - protein, 7 aa, Homo sapiens
RKFLEKE

SEQ ID NO: 28411 - protein, 7 aa, Homo sapiens
RKFLEKE

SEQ ID NO: 28412 - protein, 7 aa, Homo sapiens
RKFLEKE

SEQ ID NO: 28413 - protein, 7 aa, Homo sapiens
RKFLEKE

SEQ ID NO: 28414 - protein, 7 aa, Homo sapiens
RKFLEKE

SEQ ID NO: 28415 - protein, 7 aa, Homo sapiens
RKFLEKE

SEQ ID NO: 28416 - protein, 7 aa, Homo sapiens
RKFLEKE

SEQ ID NO: 28417 - protein, 7 aa, Homo sapiens
RKFLEKE

SEQ ID NO: 28418 - protein, 7 aa, Homo sapiens
RKFLEKE

SEQ ID NO: 28419 - protein, 7 aa, Homo sapiens
RKFLEKE

SEQ ID NO: 28420 - protein, 7 aa, Homo sapiens
RKFLEKE

SEQ ID NO: 28421 - protein, 7 aa, Homo sapiens
RKFLEKE

SEQ ID NO: 28422 - protein, 7 aa, Homo sapiens
RKFLEKE

SEQ ID NO: 28423 - protein, 7 aa, Homo sapiens
RKFLEKE

SEQ ID NO: 28424 - protein, 7 aa, Homo sapiens
RKFLEKE

SEQ ID NO: 28425 - protein, 7 aa, Homo sapiens
RKFLEKE

SEQ ID NO: 28426 - protein, 7 aa, Homo sapiens
RKFLEKE

SEQ ID NO: 28427 - protein, 7 aa, Homo sapiens
RKFLEKE

SEQ ID NO: 28428 - protein, 7 aa, Homo sapiens
RKFLEKE

SEQ ID NO: 28429 - protein, 7 aa, Homo sapiens
RKFLEKE

SEQ ID NO: 28430 - protein, 7 aa, Homo sapiens
RKFLEKE

SEQ ID NO: 28431 - protein, 7 aa, Homo sapiens
RKFLEKE

SEQ ID NO: 28432 - protein, 7 aa, Homo sapiens
RKFLEKE

SEQ ID NO: 28433 - protein, 14 aa, Homo sapiens
RLISELFQKLPSKV

SEQ ID NO: 28434 - protein, 25 aa, Homo sapiens
RLISELFQKLPSKVQYPDYYAIIKE

SEQ ID NO: 28435 - protein, 25 aa, Homo sapiens
RLISELFQKLPSKVQYPDYYAIIKE

SEQ ID NO: 28436 - protein, 25 aa, Homo sapiens
RLISELFQKLPSKVQYPDYYAIIKE

SEQ ID NO: 28437 - protein, 25 aa, Homo sapiens
RLISELFQKLPSKVQYPDYYAIIKE

SEQ ID NO: 28438 - protein, 25 aa, Homo sapiens
RLISELFQKLPSKVQYPDYYAIIKE

SEQ ID NO: 28439 - protein, 13 aa, Homo sapiens
KEPIDLKTIAQRI

SEQ ID NO: 28440 - protein, 14 aa, Homo sapiens
RLISELFQKLPSKV

SEQ ID NO: 28441 - protein, 14 aa, Homo sapiens
RLISELFQKLPSKV

SEQ ID NO: 28442 - protein, 13 aa, Homo sapiens
KEPIDLKTIAQRI

SEQ ID NO: 28443 - protein, 13 aa, Homo sapiens
KEPIDLKTIAQRI

SEQ ID NO: 28444 - protein, 14 aa, Homo sapiens
RLISELFQKLPSKV

SEQ ID NO: 28445 - protein, 13 aa, Homo sapiens
KEPIDLKTIAQRI

SEQ ID NO: 28446 - protein, 13 aa, Homo sapiens
KEPIDLKTIAQRI

SEQ ID NO: 28447 - protein, 13 aa, Homo sapiens
KEPIDLKTIAQRI

SEQ ID NO: 28448 - protein, 13 aa, Homo sapiens
KEPIDLKTIAQRI

SEQ ID NO: 28449 - protein, 13 aa, Homo sapiens
KEPIDLKTIAQRI

SEQ ID NO: 28450 - protein, 14 aa, Homo sapiens
RLISELFQKLPSKV

SEQ ID NO: 28451 - protein, 14 aa, Homo sapiens
RLISELFQKLPSKV

SEQ ID NO: 28452 - protein, 14 aa, Homo sapiens
RLISELFQKLPSKV

SEQ ID NO: 28453 - protein, 18 aa, Homo sapiens
KVGDCVFIKSHGLVRPRV

SEQ ID NO: 28454 - protein, 12 aa, Homo sapiens
RAAKVAEQQERE

SEQ ID NO: 28455 - protein, 12 aa, Homo sapiens
RAAKVAEQQERE

SEQ ID NO: 28456 - protein, 12 aa, Homo sapiens
RAAKVAEQQERE

SEQ ID NO: 28457 - protein, 9 aa, Homo sapiens
RKNVENNRY

SEQ ID NO: 28458 - protein, 9 aa, Homo sapiens
RKNVENNRY

SEQ ID NO: 28459 - protein, 9 aa, Homo sapiens
RKNVENNRY

SEQ ID NO: 28460 - protein, 9 aa, Homo sapiens
RKNVENNRY

SEQ ID NO: 28461 - protein, 12 aa, Homo sapiens
RAAKVAEQQERE

SEQ ID NO: 28462 - protein, 12 aa, Homo sapiens
RAAKVAEQQERE

SEQ ID NO: 28463 - protein, 7 aa, Homo sapiens
KKELARR

SEQ ID NO: 28464 - protein, 8 aa, Homo sapiens
KKKELARR

SEQ ID NO: 28465 - protein, 10 aa, Homo sapiens
RNPTSKYYRN

SEQ ID NO: 28466 - protein, 7 aa, Homo sapiens
KLKLSRK

SEQ ID NO: 28467 - protein, 8 aa, Homo sapiens
KKKELARR

SEQ ID NO: 28468 - protein, 6 aa, Homo sapiens
KKNIRK

SEQ ID NO: 28469 - protein, 25 aa, Homo sapiens
RRDDIEDGDSMISSATSDTGSAKRK

SEQ ID NO: 28470 - protein, 25 aa, Homo sapiens
RRDDIEDGDSMISSATSDTGSAKRK

SEQ ID NO: 28471 - protein, 25 aa, Homo sapiens
RRDDIEDGDSMISSATSDTGSAKRK

SEQ ID NO: 28472 - protein, 25 aa, Homo sapiens
RRDDIEDGDSMISSATSDTGSAKRK

SEQ ID NO: 28473 - protein, 25 aa, Homo sapiens
RRDDIEDGDSMISSATSDTGSAKRK

SEQ ID NO: 28474 - protein, 8 aa, Homo sapiens
RYSAKTKS

SEQ ID NO: 28475 - protein, 21 aa, Homo sapiens
REAEKSEDSSGAAGLSGLHRT

SEQ ID NO: 28476 - protein, 8 aa, Homo sapiens
RYSAKTKS

SEQ ID NO: 28477 - protein, 8 aa, Homo sapiens
RKEKLPKE

SEQ ID NO: 28478 - protein, 17 aa, Homo sapiens
RKINMSGYILFSSEMRA

SEQ ID NO: 28479 - protein, 17 aa, Homo sapiens
RKINMSGYILFSSEMRA

SEQ ID NO: 28480 - protein, 17 aa, Homo sapiens
RKINMSGYILFSSEMRA

SEQ ID NO: 28481 - protein, 21 aa, Homo sapiens
RNNQGQLIAEPFYHLPSKKKY

SEQ ID NO: 28482 - protein, 7 aa, Homo sapiens
REEEKRE

SEQ ID NO: 28483 - protein, 8 aa, Homo sapiens
KREEEKRE

SEQ ID NO: 28484 - protein, 7 aa, Homo sapiens
REEEKRE

SEQ ID NO: 28485 - protein, 7 aa, Homo sapiens
KLKLSRK

SEQ ID NO: 28486 - protein, 13 aa, Homo sapiens
RVLKLQQVMQAKK

SEQ ID NO: 28487 - protein, 8 aa, Homo sapiens
KKKELARR

SEQ ID NO: 28488 - protein, 13 aa, Homo sapiens
RVLKLQQVMQAKK

SEQ ID NO: 28489 - protein, 25 aa, Homo sapiens
RRDDIEDGDSMISSATSDTGSAKRK

SEQ ID NO: 28490 - protein, 25 aa, Homo sapiens
RLISELFQKLPSKVQYPDYYAIIKE

SEQ ID NO: 28491 - protein, 25 aa, Homo sapiens
RLISELFQKLPSKVQYPDYYAIIKE

SEQ ID NO: 28492 - protein, 25 aa, Homo sapiens
RLISELFQKLPSKVQYPDYYAIIKE

SEQ ID NO: 28493 - protein, 25 aa, Homo sapiens
RLISELFQKLPSKVQYPDYYAIIKE

SEQ ID NO: 28494 - protein, 25 aa, Homo sapiens
RLISELFQKLPSKVQYPDYYAIIKE

SEQ ID NO: 28495 - protein, 25 aa, Homo sapiens
RLISELFQKLPSKVQYPDYYAIIKE

SEQ ID NO: 28496 - protein, 25 aa, Homo sapiens
RLISELFQKLPSKVQYPDYYAIIKE

SEQ ID NO: 28497 - protein, 25 aa, Homo sapiens
RLISELFQKLPSKVQYPDYYAIIKE

SEQ ID NO: 28498 - protein, 25 aa, Homo sapiens
RLISELFQKLPSKVQYPDYYAIIKE

SEQ ID NO: 28499 - protein, 11 aa, Homo sapiens
KLPKEIEEDKL

SEQ ID NO: 28500 - protein, 12 aa, Homo sapiens
KHLHNDVEKERK

SEQ ID NO: 28501 - protein, 12 aa, Homo sapiens
KHLHNDVEKERK

SEQ ID NO: 28502 - protein, 11 aa, Homo sapiens
KLPKEIEEDKL

SEQ ID NO: 28503 - protein, 25 aa, Homo sapiens
RRDDIEDGDSMISSATSDTGSAKRK

SEQ ID NO: 28504 - protein, 25 aa, Homo sapiens
RRDDIEDGDSMISSATSDTGSAKRK

SEQ ID NO: 28505 - protein, 14 aa, Homo sapiens
RMKILFNVVLEARE

SEQ ID NO: 28506 - protein, 14 aa, Homo sapiens
RMKILFNVVLEARE

SEQ ID NO: 28507 - protein, 8 aa, Homo sapiens
KKKELARR

SEQ ID NO: 28508 - protein, 8 aa, Homo sapiens
KREEEKRE

SEQ ID NO: 28509 - protein, 11 aa, Homo sapiens
REEEKREAEKS

SEQ ID NO: 28510 - protein, 11 aa, Homo sapiens
KEIEEDKLKRE

SEQ ID NO: 28511 - protein, 11 aa, Homo sapiens
KEIEEDKLKRE

SEQ ID NO: 28512 - protein, 11 aa, Homo sapiens
KEIEEDKLKRE

SEQ ID NO: 28513 - protein, 11 aa, Homo sapiens
KEIEEDKLKRE

SEQ ID NO: 28514 - protein, 16 aa, Homo sapiens
KSKGAHTTMADALWRL

SEQ ID NO: 28515 - protein, 9 aa, Homo sapiens
RKNVENNRY

SEQ ID NO: 28516 - protein, 9 aa, Homo sapiens
RKNVENNRY

SEQ ID NO: 28517 - protein, 9 aa, Homo sapiens
RKNVENNRY

SEQ ID NO: 28518 - protein, 9 aa, Homo sapiens
RKNVENNRY

SEQ ID NO: 28519 - protein, 9 aa, Homo sapiens
RKNVENNRY

SEQ ID NO: 28520 - protein, 9 aa, Homo sapiens
RKNVENNRY

SEQ ID NO: 28521 - protein, 9 aa, Homo sapiens
KKAEYEERA

SEQ ID NO: 28522 - protein, 7 aa, Homo sapiens
KLKLSRK

SEQ ID NO: 28523 - protein, 7 aa, Homo sapiens
KLKLSRK

SEQ ID NO: 28524 - protein, 13 aa, Homo sapiens
RYNVPNSAIYKRV

SEQ ID NO: 28525 - protein, 13 aa, Homo sapiens
RYNVPNSAIYKRV

SEQ ID NO: 28526 - protein, 14 aa, Homo sapiens
KRYNVPNSAIYKRV

SEQ ID NO: 28527 - protein, 13 aa, Homo sapiens
RYNVPNSAIYKRV

SEQ ID NO: 28528 - protein, 14 aa, Homo sapiens
KRYNVPNSAIYKRV

SEQ ID NO: 28529 - protein, 14 aa, Homo sapiens
KRYNVPNSAIYKRV

SEQ ID NO: 28530 - protein, 13 aa, Homo sapiens
RVLKLQQVMQAKK

SEQ ID NO: 28531 - protein, 13 aa, Homo sapiens
RYNVPNSAIYKRV

SEQ ID NO: 28532 - protein, 14 aa, Homo sapiens
RVLKLQQVMQAKKK

SEQ ID NO: 28533 - protein, 13 aa, Homo sapiens
RVLKLQQVMQAKK

SEQ ID NO: 28534 - protein, 13 aa, Homo sapiens
RVLKLQQVMQAKK

SEQ ID NO: 28535 - protein, 13 aa, Homo sapiens
RVLKLQQVMQAKK

SEQ ID NO: 28536 - protein, 13 aa, Homo sapiens
RVLKLQQVMQAKK

SEQ ID NO: 28537 - protein, 13 aa, Homo sapiens
RYNVPNSAIYKRV

SEQ ID NO: 28538 - protein, 13 aa, Homo sapiens
RYNVPNSAIYKRV

SEQ ID NO: 28539 - protein, 13 aa, Homo sapiens
RVLKLQQVMQAKK

SEQ ID NO: 28540 - protein, 14 aa, Homo sapiens
KRYNVPNSAIYKRV

SEQ ID NO: 28541 - protein, 13 aa, Homo sapiens
RYNVPNSAIYKRV

SEQ ID NO: 28542 - protein, 14 aa, Homo sapiens
KRYNVPNSAIYKRV

SEQ ID NO: 28543 - protein, 13 aa, Homo sapiens
RVLKLQQVMQAKK

SEQ ID NO: 28544 - protein, 13 aa, Homo sapiens
RVLKLQQVMQAKK

SEQ ID NO: 28545 - protein, 14 aa, Homo sapiens
KRYNVPNSAIYKRV

SEQ ID NO: 28546 - protein, 13 aa, Homo sapiens
RYNVPNSAIYKRV

SEQ ID NO: 28547 - protein, 7 aa, Homo sapiens
KLKLSRK

SEQ ID NO: 28548 - protein, 7 aa, Homo sapiens
KKELARR

SEQ ID NO: 28549 - protein, 8 aa, Homo sapiens
KKKELARR

SEQ ID NO: 28550 - protein, 17 aa, Homo sapiens
RLTGPSHSKGSLGEERN

SEQ ID NO: 28551 - protein, 10 aa, Homo sapiens
RNPTSKYYRN

SEQ ID NO: 28552 - protein, 10 aa, Homo sapiens
RNPTSKYYRN

SEQ ID NO: 28553 - protein, 10 aa, Homo sapiens
RNPTSKYYRN

SEQ ID NO: 28554 - protein, 10 aa, Homo sapiens
RNPTSKYYRN

SEQ ID NO: 28555 - protein, 10 aa, Homo sapiens
RNPTSKYYRN

SEQ ID NO: 28556 - protein, 17 aa, Homo sapiens
RLTGPSHSKGSLGEERN

SEQ ID NO: 28557 - protein, 10 aa, Homo sapiens
RNPTSKYYRN

SEQ ID NO: 28558 - protein, 10 aa, Homo sapiens
RNPTSKYYRN

SEQ ID NO: 28559 - protein, 10 aa, Homo sapiens
RNPTSKYYRN

SEQ ID NO: 28560 - protein, 10 aa, Homo sapiens
RDYKDEQGRL

SEQ ID NO: 28561 - protein, 13 aa, Homo sapiens
RYNVPNSAIYKRV

SEQ ID NO: 28562 - protein, 13 aa, Homo sapiens
RYNVPNSAIYKRV

SEQ ID NO: 28563 - protein, 9 aa, Homo sapiens
KKAEYEERA

SEQ ID NO: 28564 - protein, 9 aa, Homo sapiens
KKAEYEERA

SEQ ID NO: 28565 - protein, 9 aa, Homo sapiens
RNLETAKKA

SEQ ID NO: 28566 - protein, 9 aa, Homo sapiens
RNLETAKKA

SEQ ID NO: 28567 - protein, 9 aa, Homo sapiens
RNLETAKKA

SEQ ID NO: 28568 - protein, 19 aa, Homo sapiens
RAVIKAQHPDYSFGELSRL

SEQ ID NO: 28569 - protein, 17 aa, Homo sapiens
RLTGPSHSKGSLGEERN

SEQ ID NO: 28570 - protein, 10 aa, Homo sapiens
RNPTSKYYRN

SEQ ID NO: 28571 - protein, 10 aa, Homo sapiens
RNPTSKYYRN

SEQ ID NO: 28572 - protein, 10 aa, Homo sapiens
RDYKDEQGRL

SEQ ID NO: 28573 - protein, 13 aa, Homo sapiens
RYNVPNSAIYKRV

SEQ ID NO: 28574 - protein, 13 aa, Homo sapiens
RYNVPNSAIYKRV

SEQ ID NO: 28575 - protein, 12 aa, Homo sapiens
RAAKVAEQQERE

SEQ ID NO: 28576 - protein, 9 aa, Homo sapiens
RKNVENNRY

SEQ ID NO: 28577 - protein, 14 aa, Homo sapiens
RLKLIANNTTVERR

SEQ ID NO: 28578 - protein, 14 aa, Homo sapiens
RLKLIANNTTVERR

SEQ ID NO: 28579 - protein, 14 aa, Homo sapiens
RLKLIANNTTVERR

SEQ ID NO: 28580 - protein, 11 aa, Homo sapiens
REGSPANWKRK

SEQ ID NO: 28581 - protein, 11 aa, Homo sapiens
REGSPANWKRK

SEQ ID NO: 28582 - protein, 11 aa, Homo sapiens
REGSPANWKRK

SEQ ID NO: 28583 - protein, 11 aa, Homo sapiens
REGSPANWKRK

SEQ ID NO: 28584 - protein, 11 aa, Homo sapiens
RKEKLPQVTRS

SEQ ID NO: 28585 - protein, 11 aa, Homo sapiens
RKEKLPQVTRS

SEQ ID NO: 28586 - protein, 11 aa, Homo sapiens
REGSPANWKRK

SEQ ID NO: 28587 - protein, 11 aa, Homo sapiens
REGSPANWKRK

SEQ ID NO: 28588 - protein, 11 aa, Homo sapiens
RKEKLPQVTRS

SEQ ID NO: 28589 - protein, 11 aa, Homo sapiens
REGSPANWKRK

SEQ ID NO: 28590 - protein, 22 aa, Homo sapiens
REKLTELMFEHYNIPAFFLCKT

SEQ ID NO: 28591 - protein, 22 aa, Homo sapiens
REKLTELMFEHYNIPAFFLCKT

SEQ ID NO: 28592 - protein, 22 aa, Homo sapiens
REKLTELMFEHYNIPAFFLCKT

SEQ ID NO: 28593 - protein, 22 aa, Homo sapiens
REKLTELMFEHYNIPAFFLCKT

SEQ ID NO: 28594 - protein, 22 aa, Homo sapiens
REKLTELMFEHYNIPAFFLCKT

SEQ ID NO: 28595 - protein, 15 aa, Homo sapiens
KQEYEEGGKQCVERK

SEQ ID NO: 28596 - protein, 22 aa, Homo sapiens
REKLTELMFEHYNIPAFFLCKT

SEQ ID NO: 28597 - protein, 15 aa, Homo sapiens
KQEYEEGGKQCVERK

SEQ ID NO: 28598 - protein, 15 aa, Homo sapiens
KQEYEEGGKQCVERK

SEQ ID NO: 28599 - protein, 15 aa, Homo sapiens
KQEYEEGGKQCVERK

SEQ ID NO: 28600 - protein, 22 aa, Homo sapiens
REKLTELMFEHYNIPAFFLCKT

SEQ ID NO: 28601 - protein, 15 aa, Homo sapiens
KQEYEEGGKQCVERK

SEQ ID NO: 28602 - protein, 15 aa, Homo sapiens
KQEYEEGGKQCVERK

SEQ ID NO: 28603 - protein, 15 aa, Homo sapiens
KQEYEEGGKQCVERK

SEQ ID NO: 28604 - protein, 15 aa, Homo sapiens
KQEYEEGGKQCVERK

SEQ ID NO: 28605 - protein, 8 aa, Homo sapiens
RGFKYLRL

SEQ ID NO: 28606 - protein, 8 aa, Homo sapiens
RGFKYLRL

SEQ ID NO: 28607 - protein, 9 aa, Homo sapiens
RKEKAQDRL

SEQ ID NO: 28608 - protein, 18 aa, Homo sapiens
KVIQAGMFDQKSSSHERR

SEQ ID NO: 28609 - protein, 18 aa, Homo sapiens
KVIQAGMFDQKSSSHERR

SEQ ID NO: 28610 - protein, 10 aa, Homo sapiens
REQKKENERI

SEQ ID NO: 28611 - protein, 10 aa, Homo sapiens
REQKKENERI

SEQ ID NO: 28612 - protein, 10 aa, Homo sapiens
REQKKENERI

SEQ ID NO: 28613 - protein, 9 aa, Homo sapiens
KVKIKLGRK

SEQ ID NO: 28614 - protein, 10 aa, Homo sapiens
RSVTGKIQKL

SEQ ID NO: 28615 - protein, 10 aa, Homo sapiens
RSVTGKIQKL

SEQ ID NO: 28616 - protein, 10 aa, Homo sapiens
RSVTGKIQKL

SEQ ID NO: 28617 - protein, 7 aa, Homo sapiens
RLKGGRR

SEQ ID NO: 28618 - protein, 7 aa, Homo sapiens
RLKGGRR

SEQ ID NO: 28619 - protein, 7 aa, Homo sapiens
RNHKYRS

SEQ ID NO: 28620 - protein, 7 aa, Homo sapiens
RNHKYRS

SEQ ID NO: 28621 - protein, 7 aa, Homo sapiens
RNHKYRS

SEQ ID NO: 28622 - protein, 12 aa, Homo sapiens
RLDGTTKAEDRG

SEQ ID NO: 28623 - protein, 7 aa, Homo sapiens
RNHKYRS

SEQ ID NO: 28624 - protein, 7 aa, Homo sapiens
RNHKYRS

SEQ ID NO: 28625 - protein, 7 aa, Homo sapiens
RNHKYRS

SEQ ID NO: 28626 - protein, 7 aa, Homo sapiens
RNHKYRS

SEQ ID NO: 28627 - protein, 7 aa, Homo sapiens
RNHKYRS

SEQ ID NO: 28628 - protein, 9 aa, Homo sapiens
RIRNHKYRS

SEQ ID NO: 28629 - protein, 9 aa, Homo sapiens
RIRNHKYRS

SEQ ID NO: 28630 - protein, 9 aa, Homo sapiens
RIRNHKYRS

SEQ ID NO: 28631 - protein, 9 aa, Homo sapiens
RIRNHKYRS

SEQ ID NO: 28632 - protein, 7 aa, Homo sapiens
KKIKERI

SEQ ID NO: 28633 - protein, 9 aa, Homo sapiens
RKPVDFKKI

SEQ ID NO: 28634 - protein, 7 aa, Homo sapiens
RNHKYRS

SEQ ID NO: 28635 - protein, 8 aa, Homo sapiens
RKPVDFKK

SEQ ID NO: 28636 - protein, 8 aa, Homo sapiens
RKPVDFKK

SEQ ID NO: 28637 - protein, 7 aa, Homo sapiens
KKIKERI

SEQ ID NO: 28638 - protein, 12 aa, Homo sapiens
RASGKFELLDRI

SEQ ID NO: 28639 - protein, 8 aa, Homo sapiens
RGFKYLRL

SEQ ID NO: 28640 - protein, 19 aa, Homo sapiens
KKKIPDPDSDDVSEVDARH

SEQ ID NO: 28641 - protein, 19 aa, Homo sapiens
KKKIPDPDSDDVSEVDARH

SEQ ID NO: 28642 - protein, 9 aa, Homo sapiens
RKEKAQDRL

SEQ ID NO: 28643 - protein, 9 aa, Homo sapiens
RKEKAQDRL

SEQ ID NO: 28644 - protein, 9 aa, Homo sapiens
RKEKAQDRL

SEQ ID NO: 28645 - protein, 10 aa, Homo sapiens
KQQKIEQERK

SEQ ID NO: 28646 - protein, 10 aa, Homo sapiens
KQQKIEQERK

SEQ ID NO: 28647 - protein, 10 aa, Homo sapiens
KQQKIEQERK

SEQ ID NO: 28648 - protein, 11 aa, Homo sapiens
RSRDKDDESKK

SEQ ID NO: 28649 - protein, 11 aa, Homo sapiens
RSRDKDDESKK

SEQ ID NO: 28650 - protein, 11 aa, Homo sapiens
RSRDKDDESKK

SEQ ID NO: 28651 - protein, 10 aa, Homo sapiens
REQKKENERI

SEQ ID NO: 28652 - protein, 7 aa, Homo sapiens
RIEKERM

SEQ ID NO: 28653 - protein, 10 aa, Homo sapiens
REQKKENERI

SEQ ID NO: 28654 - protein, 10 aa, Homo sapiens
REQKKENERI

SEQ ID NO: 28655 - protein, 7 aa, Homo sapiens
RIEKERM

SEQ ID NO: 28656 - protein, 7 aa, Homo sapiens
RIEKERM

SEQ ID NO: 28657 - protein, 10 aa, Homo sapiens
REQKKENERI

SEQ ID NO: 28658 - protein, 7 aa, Homo sapiens
RIEKERM

SEQ ID NO: 28659 - protein, 24 aa, Homo sapiens
RKDLYANTVLSGGTTMYPGIADRM

SEQ ID NO: 28660 - protein, 24 aa, Homo sapiens
RKDLYANTVLSGGTTMYPGIADRM

SEQ ID NO: 28661 - protein, 24 aa, Homo sapiens
RKDLYANTVLSGGTTMYPGIADRM

SEQ ID NO: 28662 - protein, 24 aa, Homo sapiens
RKDLYANTVLSGGTTMYPGIADRM

SEQ ID NO: 28663 - protein, 24 aa, Homo sapiens
RKDLYANTVLSGGTTMYPGIADRM

SEQ ID NO: 28664 - protein, 24 aa, Homo sapiens
RKDLYANTVLSGGTTMYPGIADRM

SEQ ID NO: 28665 - protein, 24 aa, Homo sapiens
RKDLYANTVLSGGTTMYPGIADRM

SEQ ID NO: 28666 - protein, 24 aa, Homo sapiens
RKDLYANTVLSGGTTMYPGIADRM

SEQ ID NO: 28667 - protein, 24 aa, Homo sapiens
RKDLYANTVLSGGTTMYPGIADRM

SEQ ID NO: 28668 - protein, 24 aa, Homo sapiens
RKDLYANTVLSGGTTMYPGIADRM

SEQ ID NO: 28669 - protein, 13 aa, Homo sapiens
RLDMEIDGQKLRD

SEQ ID NO: 28670 - protein, 13 aa, Homo sapiens
RLDMEIDGQKLRD

SEQ ID NO: 28671 - protein, 13 aa, Homo sapiens
RLDMEIDGQKLRD

SEQ ID NO: 28672 - protein, 13 aa, Homo sapiens
RLDMEIDGQKLRD

SEQ ID NO: 28673 - protein, 10 aa, Homo sapiens
KYDATKQKRK

SEQ ID NO: 28674 - protein, 10 aa, Homo sapiens
KYDATKQKRK

SEQ ID NO: 28675 - protein, 21 aa, Homo sapiens
RKRPAPQQIQQVQQQAVQNRN

SEQ ID NO: 28676 - protein, 9 aa, Homo sapiens
RKFSSFFKS

SEQ ID NO: 28677 - protein, 11 aa, Homo sapiens
RVMAAIEKVRK

SEQ ID NO: 28678 - protein, 11 aa, Homo sapiens
RVMAAIEKVRK

SEQ ID NO: 28679 - protein, 11 aa, Homo sapiens
RVMAAIEKVRK

SEQ ID NO: 28680 - protein, 11 aa, Homo sapiens
RVMAAIEKVRK

SEQ ID NO: 28681 - protein, 11 aa, Homo sapiens
RVMAAIEKVRK

SEQ ID NO: 28682 - protein, 7 aa, Homo sapiens
RHQEKKR

SEQ ID NO: 28683 - protein, 7 aa, Homo sapiens
RHQEKKR

SEQ ID NO: 28684 - protein, 7 aa, Homo sapiens
RHQEKKR

SEQ ID NO: 28685 - protein, 7 aa, Homo sapiens
RHQEKKR

SEQ ID NO: 28686 - protein, 7 aa, Homo sapiens
RHQEKKR

SEQ ID NO: 28687 - protein, 7 aa, Homo sapiens
RHQEKKR

SEQ ID NO: 28688 - protein, 8 aa, Homo sapiens
RHQEKKRK

SEQ ID NO: 28689 - protein, 7 aa, Homo sapiens
RHQEKKR

SEQ ID NO: 28690 - protein, 8 aa, Homo sapiens
RKRQEERE

SEQ ID NO: 28691 - protein, 8 aa, Homo sapiens
RKRQEERE

SEQ ID NO: 28692 - protein, 8 aa, Homo sapiens
RKRQEERE

SEQ ID NO: 28693 - protein, 8 aa, Homo sapiens
RKRQEERE

SEQ ID NO: 28694 - protein, 8 aa, Homo sapiens
RKRQEERE

SEQ ID NO: 28695 - protein, 8 aa, Homo sapiens
RKRQEERE

SEQ ID NO: 28696 - protein, 8 aa, Homo sapiens
RKRQEERE

SEQ ID NO: 28697 - protein, 16 aa, Homo sapiens
KFLESTDSFNNELKRL

SEQ ID NO: 28698 - protein, 16 aa, Homo sapiens
KFLESTDSFNNELKRL

SEQ ID NO: 28699 - protein, 17 aa, Homo sapiens
RKFLESTDSFNNELKRL

SEQ ID NO: 28700 - protein, 16 aa, Homo sapiens
KFLESTDSFNNELKRL

SEQ ID NO: 28701 - protein, 17 aa, Homo sapiens
RKFLESTDSFNNELKRL

SEQ ID NO: 28702 - protein, 16 aa, Homo sapiens
KFLESTDSFNNELKRL

SEQ ID NO: 28703 - protein, 17 aa, Homo sapiens
RKFLESTDSFNNELKRL

SEQ ID NO: 28704 - protein, 16 aa, Homo sapiens
KFLESTDSFNNELKRL

SEQ ID NO: 28705 - protein, 16 aa, Homo sapiens
KFLESTDSFNNELKRL

SEQ ID NO: 28706 - protein, 17 aa, Homo sapiens
RKFLESTDSFNNELKRL

SEQ ID NO: 28707 - protein, 16 aa, Homo sapiens
KFLESTDSFNNELKRL

SEQ ID NO: 28708 - protein, 16 aa, Homo sapiens
KFLESTDSFNNELKRL

SEQ ID NO: 28709 - protein, 17 aa, Homo sapiens
RKFLESTDSFNNELKRL

SEQ ID NO: 28710 - protein, 17 aa, Homo sapiens
RKFLESTDSFNNELKRL

SEQ ID NO: 28711 - protein, 17 aa, Homo sapiens
RKFLESTDSFNNELKRL

SEQ ID NO: 28712 - protein, 17 aa, Homo sapiens
RKFLESTDSFNNELKRL

SEQ ID NO: 28713 - protein, 13 aa, Homo sapiens
RVEGKLLDDPSKQ

SEQ ID NO: 28714 - protein, 13 aa, Homo sapiens
RVEGKLLDDPSKQ

SEQ ID NO: 28715 - protein, 13 aa, Homo sapiens
RVEGKLLDDPSKQ

SEQ ID NO: 28716 - protein, 13 aa, Homo sapiens
RVEGKLLDDPSKQ

SEQ ID NO: 28717 - protein, 13 aa, Homo sapiens
RVEGKLLDDPSKQ

SEQ ID NO: 28718 - protein, 9 aa, Homo sapiens
KKVQEAARA

SEQ ID NO: 28719 - protein, 9 aa, Homo sapiens
KKVQEAARA

SEQ ID NO: 28720 - protein, 17 aa, Homo sapiens
RVASAAAKAALEEFSRV

SEQ ID NO: 28721 - protein, 17 aa, Homo sapiens
RVASAAAKAALEEFSRV

SEQ ID NO: 28722 - protein, 12 aa, Homo sapiens
KAKHLAAVEERK

SEQ ID NO: 28723 - protein, 12 aa, Homo sapiens
KAKHLAAVEERK

SEQ ID NO: 28724 - protein, 12 aa, Homo sapiens
KAKHLAAVEERK

SEQ ID NO: 28725 - protein, 12 aa, Homo sapiens
KAKHLAAVEERK

SEQ ID NO: 28726 - protein, 12 aa, Homo sapiens
KAKHLAAVEERK

SEQ ID NO: 28727 - protein, 12 aa, Homo sapiens
KAKHLAAVEERK

SEQ ID NO: 28728 - protein, 12 aa, Homo sapiens
KAKHLAAVEERK

SEQ ID NO: 28729 - protein, 12 aa, Homo sapiens
KAKHLAAVEERK

SEQ ID NO: 28730 - protein, 12 aa, Homo sapiens
KAKHLAAVEERK

SEQ ID NO: 28731 - protein, 12 aa, Homo sapiens
KAKHLAAVEERK

SEQ ID NO: 28732 - protein, 12 aa, Homo sapiens
KAKHLAAVEERK

SEQ ID NO: 28733 - protein, 12 aa, Homo sapiens
KAKHLAAVEERK

SEQ ID NO: 28734 - protein, 12 aa, Homo sapiens
KAKHLAAVEERK

SEQ ID NO: 28735 - protein, 12 aa, Homo sapiens
KAKHLAAVEERK

SEQ ID NO: 28736 - protein, 12 aa, Homo sapiens
KAKHLAAVEERK

SEQ ID NO: 28737 - protein, 12 aa, Homo sapiens
KAKHLAAVEERK

SEQ ID NO: 28738 - protein, 12 aa, Homo sapiens
KAKHLAAVEERK

SEQ ID NO: 28739 - protein, 12 aa, Homo sapiens
KAKHLAAVEERK

SEQ ID NO: 28740 - protein, 12 aa, Homo sapiens
KAKHLAAVEERK

SEQ ID NO: 28741 - protein, 12 aa, Homo sapiens
KAKHLAAVEERK

SEQ ID NO: 28742 - protein, 12 aa, Homo sapiens
KAKHLAAVEERK

SEQ ID NO: 28743 - protein, 12 aa, Homo sapiens
KAKHLAAVEERK

SEQ ID NO: 28744 - protein, 17 aa, Homo sapiens
RVASAAAKAALEEFSRV

SEQ ID NO: 28745 - protein, 17 aa, Homo sapiens
RVASAAAKAALEEFSRV

SEQ ID NO: 28746 - protein, 17 aa, Homo sapiens
RVASAAAKAALEEFSRV

SEQ ID NO: 28747 - protein, 17 aa, Homo sapiens
RVASAAAKAALEEFSRV

SEQ ID NO: 28748 - protein, 17 aa, Homo sapiens
RVASAAAKAALEEFSRV

SEQ ID NO: 28749 - protein, 8 aa, Homo sapiens
RKPVSFRQ

SEQ ID NO: 28750 - protein, 8 aa, Homo sapiens
RKPVSFRQ

SEQ ID NO: 28751 - protein, 8 aa, Homo sapiens
RKPVSFRQ

SEQ ID NO: 28752 - protein, 8 aa, Homo sapiens
RKPVSFRQ

SEQ ID NO: 28753 - protein, 13 aa, Homo sapiens
KSKTPEIYLAYRN

SEQ ID NO: 28754 - protein, 9 aa, Homo sapiens
RKASANARK

SEQ ID NO: 28755 - protein, 9 aa, Homo sapiens
RKASANARK

SEQ ID NO: 28756 - protein, 17 aa, Homo sapiens
RKIKSLVALLVETQMKK

SEQ ID NO: 28757 - protein, 17 aa, Homo sapiens
RKIKSLVALLVETQMKK

SEQ ID NO: 28758 - protein, 17 aa, Homo sapiens
RKIKSLVALLVETQMKK

SEQ ID NO: 28759 - protein, 17 aa, Homo sapiens
RKIKSLVALLVETQMKK

SEQ ID NO: 28760 - protein, 17 aa, Homo sapiens
RKIKSLVALLVETQMKK

SEQ ID NO: 28761 - protein, 12 aa, Homo sapiens
KAKHLAAVEERK

SEQ ID NO: 28762 - protein, 16 aa, Homo sapiens
KNKEKPVDLQNFGLRT

SEQ ID NO: 28763 - protein, 12 aa, Homo sapiens
KAKHLAAVEERK

SEQ ID NO: 28764 - protein, 20 aa, Homo sapiens
RSPQVPAAQQMLNFPEKNKE

SEQ ID NO: 28765 - protein, 20 aa, Homo sapiens
RSPQVPAAQQMLNFPEKNKE

SEQ ID NO: 28766 - protein, 20 aa, Homo sapiens
RSPQVPAAQQMLNFPEKNKE

SEQ ID NO: 28767 - protein, 14 aa, Homo sapiens
KEKPVDLQNFGLRT

SEQ ID NO: 28768 - protein, 14 aa, Homo sapiens
KEKPVDLQNFGLRT

SEQ ID NO: 28769 - protein, 9 aa, Homo sapiens
KKVQEAARA

SEQ ID NO: 28770 - protein, 9 aa, Homo sapiens
KKVQEAARA

SEQ ID NO: 28771 - protein, 9 aa, Homo sapiens
KKVQEAARA

SEQ ID NO: 28772 - protein, 9 aa, Homo sapiens
KKVQEAARA

SEQ ID NO: 28773 - protein, 10 aa, Homo sapiens
RKDGGPATKF

SEQ ID NO: 28774 - protein, 9 aa, Homo sapiens
RKASANARK

SEQ ID NO: 28775 - protein, 9 aa, Homo sapiens
RKASANARK

SEQ ID NO: 28776 - protein, 11 aa, Homo sapiens
RDRKASANARK

SEQ ID NO: 28777 - protein, 9 aa, Homo sapiens
RKASANARK

SEQ ID NO: 28778 - protein, 9 aa, Homo sapiens
RKASANARK

SEQ ID NO: 28779 - protein, 9 aa, Homo sapiens
RKASANARK

SEQ ID NO: 28780 - protein, 20 aa, Homo sapiens
RITDHYKEYSQMQQQNTQKV

SEQ ID NO: 28781 - protein, 10 aa, Homo sapiens
KYKVLPTERT

SEQ ID NO: 28782 - protein, 10 aa, Homo sapiens
KYKVLPTERT

SEQ ID NO: 28783 - protein, 10 aa, Homo sapiens
KYKVLPTERT

SEQ ID NO: 28784 - protein, 23 aa, Homo sapiens
RTKVSSYPVALIPGQFQEYYKRY

SEQ ID NO: 28785 - protein, 10 aa, Homo sapiens
KYKVLPTERT

SEQ ID NO: 28786 - protein, 10 aa, Homo sapiens
KYKVLPTERT

SEQ ID NO: 28787 - protein, 10 aa, Homo sapiens
KYKVLPTERT

SEQ ID NO: 28788 - protein, 10 aa, Homo sapiens
KYKVLPTERT

SEQ ID NO: 28789 - protein, 23 aa, Homo sapiens
RTKVSSYPVALIPGQFQEYYKRY

SEQ ID NO: 28790 - protein, 23 aa, Homo sapiens
RTKVSSYPVALIPGQFQEYYKRY

SEQ ID NO: 28791 - protein, 10 aa, Homo sapiens
KYKVLPTERT

SEQ ID NO: 28792 - protein, 8 aa, Homo sapiens
RKDGPKRS

SEQ ID NO: 28793 - protein, 8 aa, Homo sapiens
RKDGPKRS

SEQ ID NO: 28794 - protein, 6 aa, Homo sapiens
RKVGRR

SEQ ID NO: 28795 - protein, 11 aa, Homo sapiens
KSKDKAATPRK

SEQ ID NO: 28796 - protein, 9 aa, Homo sapiens
KDKAATPRK

SEQ ID NO: 28797 - protein, 13 aa, Homo sapiens
RDLSHKEKLYLRE

SEQ ID NO: 28798 - protein, 13 aa, Homo sapiens
RDLSHKEKLYLRE

SEQ ID NO: 28799 - protein, 13 aa, Homo sapiens
RDLSHKEKLYLRE

SEQ ID NO: 28800 - protein, 9 aa, Homo sapiens
RDLSHKEKL

SEQ ID NO: 28801 - protein, 9 aa, Homo sapiens
RDLSHKEKL

SEQ ID NO: 28802 - protein, 9 aa, Homo sapiens
RKYPDLERR

SEQ ID NO: 28803 - protein, 8 aa, Homo sapiens
RKDGPKRS

SEQ ID NO: 28804 - protein, 7 aa, Homo sapiens
RKDGPKR

SEQ ID NO: 28805 - protein, 8 aa, Homo sapiens
KGKESNKK

SEQ ID NO: 28806 - protein, 13 aa, Homo sapiens
RDLSHKEKLYLRE

SEQ ID NO: 28807 - protein, 10 aa, Homo sapiens
KRKYPDLERR

SEQ ID NO: 28808 - protein, 9 aa, Homo sapiens
RKYPDLERR

SEQ ID NO: 28809 - protein, 9 aa, Homo sapiens
RKYPDLERR

SEQ ID NO: 28810 - protein, 9 aa, Homo sapiens
RDLSHKEKL

SEQ ID NO: 28811 - protein, 9 aa, Homo sapiens
RDLSHKEKL

SEQ ID NO: 28812 - protein, 9 aa, Homo sapiens
RDLSHKEKL

SEQ ID NO: 28813 - protein, 10 aa, Homo sapiens
KRKYPDLERR

SEQ ID NO: 28814 - protein, 10 aa, Homo sapiens
KRKYPDLERR

SEQ ID NO: 28815 - protein, 9 aa, Homo sapiens
RKYPDLERR

SEQ ID NO: 28816 - protein, 9 aa, Homo sapiens
RKYPDLERR

SEQ ID NO: 28817 - protein, 9 aa, Homo sapiens
RKYPDLERR

SEQ ID NO: 28818 - protein, 8 aa, Homo sapiens
KEKLYLRE

SEQ ID NO: 28819 - protein, 8 aa, Homo sapiens
KEKLYLRE

SEQ ID NO: 28820 - protein, 8 aa, Homo sapiens
KEKLYLRE

SEQ ID NO: 28821 - protein, 17 aa, Homo sapiens
RSDEVIDLMIKEYPAKH

SEQ ID NO: 28822 - protein, 17 aa, Homo sapiens
RSDEVIDLMIKEYPAKH

SEQ ID NO: 28823 - protein, 17 aa, Homo sapiens
RSDEVIDLMIKEYPAKH

SEQ ID NO: 28824 - protein, 17 aa, Homo sapiens
RSDEVIDLMIKEYPAKH

SEQ ID NO: 28825 - protein, 17 aa, Homo sapiens
RSDEVIDLMIKEYPAKH

SEQ ID NO: 28826 - protein, 17 aa, Homo sapiens
RSDEVIDLMIKEYPAKH

SEQ ID NO: 28827 - protein, 17 aa, Homo sapiens
RSDEVIDLMIKEYPAKH

SEQ ID NO: 28828 - protein, 17 aa, Homo sapiens
RSDEVIDLMIKEYPAKH

SEQ ID NO: 28829 - protein, 17 aa, Homo sapiens
RSDEVIDLMIKEYPAKH

SEQ ID NO: 28830 - protein, 9 aa, Homo sapiens
RKYPDLERR

SEQ ID NO: 28831 - protein, 9 aa, Homo sapiens
RKYPDLERR

SEQ ID NO: 28832 - protein, 17 aa, Homo sapiens
RSDEVIDLMIKEYPAKH

SEQ ID NO: 28833 - protein, 9 aa, Homo sapiens
RKYPDLERR

SEQ ID NO: 28834 - protein, 9 aa, Homo sapiens
RKYPDLERR

SEQ ID NO: 28835 - protein, 9 aa, Homo sapiens
RKYPDLERR

SEQ ID NO: 28836 - protein, 10 aa, Homo sapiens
KRKYPDLERR

SEQ ID NO: 28837 - protein, 20 aa, Homo sapiens
KEYPAKHAEYSVILQEKERQ

SEQ ID NO: 28838 - protein, 20 aa, Homo sapiens
KEYPAKHAEYSVILQEKERQ

SEQ ID NO: 28839 - protein, 10 aa, Homo sapiens
RKYPDLERRD

SEQ ID NO: 28840 - protein, 9 aa, Homo sapiens
RKYPDLERR

SEQ ID NO: 28841 - protein, 10 aa, Homo sapiens
RKYPDLERRD

SEQ ID NO: 28842 - protein, 10 aa, Homo sapiens
RKYPDLERRD

SEQ ID NO: 28843 - protein, 9 aa, Homo sapiens
RKYPDLERR

SEQ ID NO: 28844 - protein, 20 aa, Homo sapiens
KEYPAKHAEYSVILQEKERQ

SEQ ID NO: 28845 - protein, 10 aa, Homo sapiens
RKYPDLERRD

SEQ ID NO: 28846 - protein, 9 aa, Homo sapiens
RKYPDLERR

SEQ ID NO: 28847 - protein, 20 aa, Homo sapiens
KEYPAKHAEYSVILQEKERQ

SEQ ID NO: 28848 - protein, 20 aa, Homo sapiens
KEYPAKHAEYSVILQEKERQ

SEQ ID NO: 28849 - protein, 20 aa, Homo sapiens
KEYPAKHAEYSVILQEKERQ

SEQ ID NO: 28850 - protein, 9 aa, Homo sapiens
RKYPDLERR

SEQ ID NO: 28851 - protein, 20 aa, Homo sapiens
KEYPAKHAEYSVILQEKERQ

SEQ ID NO: 28852 - protein, 20 aa, Homo sapiens
KEYPAKHAEYSVILQEKERQ

SEQ ID NO: 28853 - protein, 20 aa, Homo sapiens
KEYPAKHAEYSVILQEKERQ

SEQ ID NO: 28854 - protein, 9 aa, Homo sapiens
RKYPDLERR

SEQ ID NO: 28855 - protein, 20 aa, Homo sapiens
KEYPAKHAEYSVILQEKERQ

SEQ ID NO: 28856 - protein, 9 aa, Homo sapiens
RKYPDLERR

SEQ ID NO: 28857 - protein, 20 aa, Homo sapiens
KEYPAKHAEYSVILQEKERQ

SEQ ID NO: 28858 - protein, 20 aa, Homo sapiens
KEYPAKHAEYSVILQEKERQ

SEQ ID NO: 28859 - protein, 20 aa, Homo sapiens
KEYPAKHAEYSVILQEKERQ

SEQ ID NO: 28860 - protein, 20 aa, Homo sapiens
KEYPAKHAEYSVILQEKERQ

SEQ ID NO: 28861 - protein, 10 aa, Homo sapiens
RKYPDLERRD

SEQ ID NO: 28862 - protein, 9 aa, Homo sapiens
RKYPDLERR

SEQ ID NO: 28863 - protein, 10 aa, Homo sapiens
RKYPDLERRD

SEQ ID NO: 28864 - protein, 20 aa, Homo sapiens
KEYPAKHAEYSVILQEKERQ

SEQ ID NO: 28865 - protein, 20 aa, Homo sapiens
KEYPAKHAEYSVILQEKERQ

SEQ ID NO: 28866 - protein, 9 aa, Homo sapiens
RKYPDLERR

SEQ ID NO: 28867 - protein, 9 aa, Homo sapiens
RKYPDLERR

SEQ ID NO: 28868 - protein, 9 aa, Homo sapiens
RKYPDLERR

SEQ ID NO: 28869 - protein, 20 aa, Homo sapiens
KEYPAKHAEYSVILQEKERQ

SEQ ID NO: 28870 - protein, 9 aa, Homo sapiens
RKYPDLERR

SEQ ID NO: 28871 - protein, 9 aa, Homo sapiens
RKYPDLERR

SEQ ID NO: 28872 - protein, 9 aa, Homo sapiens
RKYPDLERR

SEQ ID NO: 28873 - protein, 9 aa, Homo sapiens
RKYPDLERR

SEQ ID NO: 28874 - protein, 9 aa, Homo sapiens
RKYPDLERR

SEQ ID NO: 28875 - protein, 9 aa, Homo sapiens
RKYPDLERR

SEQ ID NO: 28876 - protein, 9 aa, Homo sapiens
RKYPDLERR

SEQ ID NO: 28877 - protein, 9 aa, Homo sapiens
RKYPDLERR

SEQ ID NO: 28878 - protein, 18 aa, Homo sapiens
KEYPAKHAEYSVILQEKE

SEQ ID NO: 28879 - protein, 10 aa, Homo sapiens
RKYPDLERRD

SEQ ID NO: 28880 - protein, 9 aa, Homo sapiens
RKYPDLERR

SEQ ID NO: 28881 - protein, 9 aa, Homo sapiens
RKYPDLERR

SEQ ID NO: 28882 - protein, 9 aa, Homo sapiens
RKYPDLERR

SEQ ID NO: 28883 - protein, 10 aa, Homo sapiens
KRKYPDLERR

SEQ ID NO: 28884 - protein, 9 aa, Homo sapiens
RKYPDLERR

SEQ ID NO: 28885 - protein, 9 aa, Homo sapiens
RKYPDLERR

SEQ ID NO: 28886 - protein, 9 aa, Homo sapiens
RKYPDLERR

SEQ ID NO: 28887 - protein, 9 aa, Homo sapiens
RKYPDLERR

SEQ ID NO: 28888 - protein, 9 aa, Homo sapiens
RKYPDLERR

SEQ ID NO: 28889 - protein, 10 aa, Homo sapiens
RKYPDLERRD

SEQ ID NO: 28890 - protein, 10 aa, Homo sapiens
KRKYPDLERR

SEQ ID NO: 28891 - protein, 9 aa, Homo sapiens
RKYPDLERR

SEQ ID NO: 28892 - protein, 10 aa, Homo sapiens
KRKYPDLERR

SEQ ID NO: 28893 - protein, 10 aa, Homo sapiens
KRKYPDLERR

SEQ ID NO: 28894 - protein, 10 aa, Homo sapiens
KRKYPDLERR

SEQ ID NO: 28895 - protein, 10 aa, Homo sapiens
RKYPDLERRD

SEQ ID NO: 28896 - protein, 10 aa, Homo sapiens
RKYPDLERRD

SEQ ID NO: 28897 - protein, 10 aa, Homo sapiens
RKYPDLERRD

SEQ ID NO: 28898 - protein, 10 aa, Homo sapiens
RKYPDLERRD

SEQ ID NO: 28899 - protein, 6 aa, Homo sapiens
RKVGRR

SEQ ID NO: 28900 - protein, 13 aa, Homo sapiens
KVEASKVPEYIKK

SEQ ID NO: 28901 - protein, 12 aa, Homo sapiens
KVPEYIKKAAKK

SEQ ID NO: 28902 - protein, 12 aa, Homo sapiens
KVPEYIKKAAKK

SEQ ID NO: 28903 - protein, 13 aa, Homo sapiens
KKAAEFNSNLNRE

SEQ ID NO: 28904 - protein, 9 aa, Homo sapiens
KDKAATPRK

SEQ ID NO: 28905 - protein, 15 aa, Homo sapiens
KHAEYSVILQEKERQ

SEQ ID NO: 28906 - protein, 6 aa, Homo sapiens
RKVGRR

SEQ ID NO: 28907 - protein, 6 aa, Homo sapiens
RKVGRR

SEQ ID NO: 28908 - protein, 7 aa, Homo sapiens
RKVGRRG

SEQ ID NO: 28909 - protein, 10 aa, Homo sapiens
KYKVLPTERT

SEQ ID NO: 28910 - protein, 20 aa, Homo sapiens
RITDHYKEYSQMQQQNTQKV

SEQ ID NO: 28911 - protein, 20 aa, Homo sapiens
RITDHYKEYSQMQQQNTQKV

SEQ ID NO: 28912 - protein, 13 aa, Homo sapiens
RDLSHKEKLYLRE

SEQ ID NO: 28913 - protein, 13 aa, Homo sapiens
RDLSHKEKLYLRE

SEQ ID NO: 28914 - protein, 8 aa, Homo sapiens
KEKLYLRE

SEQ ID NO: 28915 - protein, 8 aa, Homo sapiens
KEKLYLRE

SEQ ID NO: 28916 - protein, 7 aa, Homo sapiens
RKDGPKR

SEQ ID NO: 28917 - protein, 11 aa, Homo sapiens
KSKDKAATPRK

SEQ ID NO: 28918 - protein, 8 aa, Homo sapiens
EQKKETER

SEQ ID NO: 28919 - protein, 5 aa, Homo sapiens
NHKYR

SEQ ID NO: 28920 - protein, 5 aa, Homo sapiens
NHKYR

SEQ ID NO: 28921 - protein, 5 aa, Homo sapiens
NHKYR

SEQ ID NO: 28922 - protein, 8 aa, Homo sapiens
EQKKETER

SEQ ID NO: 28923 - protein, 11 aa, Homo sapiens
VEGKLLDDPSK

SEQ ID NO: 28924 - protein, 10 aa, Homo sapiens
KGLAFLDELR

SEQ ID NO: 28925 - protein, 10 aa, Homo sapiens
KGLAFLDELR

SEQ ID NO: 28926 - protein, 10 aa, Homo sapiens
KGLAFLDELR

SEQ ID NO: 28927 - protein, 17 aa, Homo sapiens
AQKAIVNHPSAALMALR

SEQ ID NO: 28928 - protein, 17 aa, Homo sapiens
AQKAIVNHPSAALMALR

SEQ ID NO: 28929 - protein, 17 aa, Homo sapiens
AQKAIVNHPSAALMALR

SEQ ID NO: 28930 - protein, 17 aa, Homo sapiens
AQKAIVNHPSAALMALR

SEQ ID NO: 28931 - protein, 10 aa, Homo sapiens
TVFPNHTVKR

SEQ ID NO: 28932 - protein, 10 aa, Homo sapiens
TVFPNHTVKR

SEQ ID NO: 28933 - protein, 10 aa, Homo sapiens
TVFPNHTVKR

SEQ ID NO: 28934 - protein, 15 aa, Homo sapiens
EEEAKEATGLHVHER

SEQ ID NO: 28935 - protein, 15 aa, Homo sapiens
EEEAKEATGLHVHER

SEQ ID NO: 28936 - protein, 15 aa, Homo sapiens
EEEAKEATGLHVHER

SEQ ID NO: 28937 - protein, 41 aa, Homo sapiens; identical to SEQ ID NO: 26453

SEQ ID NO: 28938 - protein, 13 aa, Homo sapiens
VTTLGGFAKVSEK

SEQ ID NO: 28939 - protein, 8 aa, Homo sapiens
FKSNNLER

SEQ ID NO: 28940 - protein, 8 aa, Homo sapiens
FKSNNLER

SEQ ID NO: 28941 - protein, 8 aa, Homo sapiens
IVKESGGK

SEQ ID NO: 28942 - protein, 8 aa, Homo sapiens
IVKESGGK

SEQ ID NO: 28943 - protein, 20 aa, Homo sapiens
EPKEGQEEVLKEVVESEGER

SEQ ID NO: 28944 - protein, 20 aa, Homo sapiens
EPKEGQEEVLKEVVESEGER

SEQ ID NO: 28945 - protein, 11 aa, Homo sapiens
EPKEGQEEVLK

SEQ ID NO: 28946 - protein, 11 aa, Homo sapiens
EPKEGQEEVLK

SEQ ID NO: 28947 - protein, 7 aa, Homo sapiens
KEPKEPR

SEQ ID NO: 28948 - protein, 7 aa, Homo sapiens
KEPKEPR

SEQ ID NO: 28949 - protein, 7 aa, Homo sapiens
KEPKEPR

SEQ ID NO: 28950 - protein, 8 aa, Homo sapiens
EKTSEAPK

SEQ ID NO: 28951 - protein, 8 aa, Homo sapiens
EKTSEAPK

SEQ ID NO: 28952 - protein, 8 aa, Homo sapiens
GKEGDSEK

SEQ ID NO: 28953 - protein, 8 aa, Homo sapiens
GKEGDSEK

SEQ ID NO: 28954 - protein, 5 aa, Homo sapiens
KDEEK

SEQ ID NO: 28955 - protein, 5 aa, Homo sapiens
KDEEK

SEQ ID NO: 28956 - protein, 7 aa, Homo sapiens
KDEEKGK

SEQ ID NO: 28957 - protein, 7 aa, Homo sapiens
KDEEKGK

SEQ ID NO: 28958 - protein, 5 aa, Homo sapiens
KDEEK

SEQ ID NO: 28959 - protein, 5 aa, Homo sapiens
KDEEK

SEQ ID NO: 28960 - protein, 7 aa, Homo sapiens
KDEEKGK

SEQ ID NO: 28961 - protein, 7 aa, Homo sapiens
KDEEKGK

SEQ ID NO: 28962 - protein, 7 aa, Homo sapiens
KDEEKGK

SEQ ID NO: 28963 - protein, 7 aa, Homo sapiens
KDEEKGK

SEQ ID NO: 28964 - protein, 5 aa, Homo sapiens
EKEPK

SEQ ID NO: 28965 - protein, 5 aa, Homo sapiens
EKEPK

SEQ ID NO: 28966 - protein, 9 aa, Homo sapiens
KKDGGPNVK

SEQ ID NO: 28967 - protein, 9 aa, Homo sapiens
KKDGGPNVK

SEQ ID NO: 28968 - protein, 9 aa, Homo sapiens
KKDGGPNVK

SEQ ID NO: 28969 - protein, 9 aa, Homo sapiens
KKDGGPNVK

SEQ ID NO: 28970 - protein, 9 aa, Homo sapiens
KKDGGPNVK

SEQ ID NO: 28971 - protein, 19 aa, Homo sapiens
TPQQTSASQQMLNFPDKGK

SEQ ID NO: 28972 - protein, 11 aa, Homo sapiens
TSEAPKKDEEK

SEQ ID NO: 28973 - protein, 11 aa, Homo sapiens
TSEAPKKDEEK

SEQ ID NO: 28974 - protein, 7 aa, Homo sapiens
KDEEKGK

SEQ ID NO: 28975 - protein, 11 aa, Homo sapiens
TSEAPKKDEEK

SEQ ID NO: 28976 - protein, 7 aa, Homo sapiens
KDEEKGK

SEQ ID NO: 28977 - protein, 5 aa, Homo sapiens
KDEEK

SEQ ID NO: 28978 - protein, 5 aa, Homo sapiens
KDEEK

SEQ ID NO: 28979 - protein, 5 aa, Homo sapiens
KDEEK

SEQ ID NO: 28980 - protein, 11 aa, Homo sapiens
TSEAPKKDEEK

SEQ ID NO: 28981 - protein, 11 aa, Homo sapiens
TSEAPKKDEEK

SEQ ID NO: 28982 - protein, 7 aa, Homo sapiens
KVEEAAK

SEQ ID NO: 28983 - protein, 7 aa, Homo sapiens
KVEEAAK

SEQ ID NO: 28984 - protein, 7 aa, Homo sapiens
KVEEAAK

SEQ ID NO: 28985 - protein, 7 aa, Homo sapiens
KVEEAAK

SEQ ID NO: 28986 - protein, 7 aa, Homo sapiens
KVEEAAK

SEQ ID NO: 28987 - protein, 7 aa, Homo sapiens
KVEEAAK

SEQ ID NO: 28988 - protein, 7 aa, Homo sapiens
KVEEAAK

SEQ ID NO: 28989 - protein, 7 aa, Homo sapiens
KVEEAAK

SEQ ID NO: 28990 - protein, 7 aa, Homo sapiens
KVEEAAK

SEQ ID NO: 28991 - protein, 7 aa, Homo sapiens
KVEEAAK

SEQ ID NO: 28992 - protein, 7 aa, Homo sapiens
KVEEAAK

SEQ ID NO: 28993 - protein, 7 aa, Homo sapiens
KVEEAAK

SEQ ID NO: 28994 - protein, 6 aa, Homo sapiens
KTKVER

SEQ ID NO: 28995 - protein, 6 aa, Homo sapiens
KTKVER

SEQ ID NO: 28996 - protein, 7 aa, Homo sapiens
KVEEAAK

SEQ ID NO: 28997 - protein, 12 aa, Homo sapiens
GKEGDSEKESEK

SEQ ID NO: 28998 - protein, 12 aa, Homo sapiens
GKEGDSEKESEK

SEQ ID NO: 28999 - protein, 12 aa, Homo sapiens
GKEGDSEKESEK

SEQ ID NO: 29000 - protein, 8 aa, Homo sapiens
GKEGDSEK

SEQ ID NO: 29001 - protein, 8 aa, Homo sapiens
GKEGDSEK

SEQ ID NO: 29002 - protein, 8 aa, Homo sapiens
GKEGDSEK

SEQ ID NO: 29003 - protein, 17 aa, Homo sapiens
EGQEEVLKEVVESEGER

SEQ ID NO: 29004 - protein, 17 aa, Homo sapiens
EGQEEVLKEVVESEGER

SEQ ID NO: 29005 - protein, 17 aa, Homo sapiens
EGQEEVLKEVVESEGER

SEQ ID NO: 29006 - protein, 17 aa, Homo sapiens
EGQEEVLKEVVESEGER

SEQ ID NO: 29007 - protein, 6 aa, Homo sapiens
KTKVER

SEQ ID NO: 29008 - protein, 17 aa, Homo sapiens
EGQEEVLKEVVESEGER

SEQ ID NO: 29009 - protein, 17 aa, Homo sapiens
EGQEEVLKEVVESEGER

SEQ ID NO: 29010 - protein, 17 aa, Homo sapiens
EGQEEVLKEVVESEGER

SEQ ID NO: 29011 - protein, 17 aa, Homo sapiens
EGQEEVLKEVVESEGER

SEQ ID NO: 29012 - protein, 6 aa, Homo sapiens
KTKVER

SEQ ID NO: 29013 - protein, 6 aa, Homo sapiens
KTKVER

SEQ ID NO: 29014 - protein, 6 aa, Homo sapiens
KTKVER

SEQ ID NO: 29015 - protein, 6 aa, Homo sapiens
KTKVER

SEQ ID NO: 29016 - protein, 6 aa, Homo sapiens
KTKVER

SEQ ID NO: 29017 - protein, 5 aa, Homo sapiens
TKVER

SEQ ID NO: 29018 - protein, 6 aa, Homo sapiens
KTKVER

SEQ ID NO: 29019 - protein, 6 aa, Homo sapiens
KTKVER

SEQ ID NO: 29020 - protein, 6 aa, Homo sapiens
KTKVER

SEQ ID NO: 29021 - protein, 6 aa, Homo sapiens
KTKVER

SEQ ID NO: 29022 - protein, 6 aa, Homo sapiens
KTKVER

SEQ ID NO: 29023 - protein, 6 aa, Homo sapiens
KTKVER

SEQ ID NO: 29024 - protein, 5 aa, Homo sapiens
TKVER

SEQ ID NO: 29025 - protein, 6 aa, Homo sapiens
KTKVER

SEQ ID NO: 29026 - protein, 6 aa, Homo sapiens
KTKVER

SEQ ID NO: 29027 - protein, 6 aa, Homo sapiens
KTKVER

SEQ ID NO: 29028 - protein, 6 aa, Homo sapiens
KTKVER

SEQ ID NO: 29029 - protein, 15 aa, Homo sapiens
MKEEVPTALVEAHVR

SEQ ID NO: 29030 - protein, 7 aa, Homo sapiens
KVEEAAK

SEQ ID NO: 29031 - protein, 7 aa, Homo sapiens
KVEEAAK

SEQ ID NO: 29032 - protein, 15 aa, Homo sapiens
MKEEVPTALVEAHVR

SEQ ID NO: 29033 - protein, 15 aa, Homo sapiens
MKEEVPTALVEAHVR

SEQ ID NO: 29034 - protein, 5 aa, Homo sapiens
TKVER

SEQ ID NO: 29035 - protein, 15 aa, Homo sapiens
MKEEVPTALVEAHVR

SEQ ID NO: 29036 - protein, 10 aa, Homo sapiens
AKHLAAVEER

SEQ ID NO: 29037 - protein, 10 aa, Homo sapiens
AKHLAAVEER

SEQ ID NO: 29038 - protein, 10 aa, Homo sapiens
AKHLAAVEER

SEQ ID NO: 29039 - protein, 15 aa, Homo sapiens
MKEEVPTALVEAHVR

SEQ ID NO: 29040 - protein, 15 aa, Homo sapiens
MKEEVPTALVEAHVR

SEQ ID NO: 29041 - protein, 15 aa, Homo sapiens
MKEEVPTALVEAHVR

SEQ ID NO: 29042 - protein, 15 aa, Homo sapiens
MKEEVPTALVEAHVR

SEQ ID NO: 29043 - protein, 15 aa, Homo sapiens
MKEEVPTALVEAHVR

SEQ ID NO: 29044 - protein, 15 aa, Homo sapiens
MKEEVPTALVEAHVR

SEQ ID NO: 29045 - protein, 10 aa, Homo sapiens
AKHLAAVEER

SEQ ID NO: 29046 - protein, 10 aa, Homo sapiens
AKHLAAVEER

SEQ ID NO: 29047 - protein, 15 aa, Homo sapiens
MKEEVPTALVEAHVR

SEQ ID NO: 29048 - protein, 10 aa, Homo sapiens
AKHLAAVEER

SEQ ID NO: 29049 - protein, 15 aa, Homo sapiens
MKEEVPTALVEAHVR

SEQ ID NO: 29050 - protein, 15 aa, Homo sapiens
MKEEVPTALVEAHVR

SEQ ID NO: 29051 - protein, 15 aa, Homo sapiens
MKEEVPTALVEAHVR

SEQ ID NO: 29052 - protein, 15 aa, Homo sapiens
MKEEVPTALVEAHVR

SEQ ID NO: 29053 - protein, 15 aa, Homo sapiens
MKEEVPTALVEAHVR

SEQ ID NO: 29054 - protein, 15 aa, Homo sapiens
MKEEVPTALVEAHVR

SEQ ID NO: 29055 - protein, 15 aa, Homo sapiens
MKEEVPTALVEAHVR

SEQ ID NO: 29056 - protein, 15 aa, Homo sapiens
MKEEVPTALVEAHVR

SEQ ID NO: 29057 - protein, 15 aa, Homo sapiens
MKEEVPTALVEAHVR

SEQ ID NO: 29058 - protein, 15 aa, Homo sapiens
MKEEVPTALVEAHVR

SEQ ID NO: 29059 - protein, 10 aa, Homo sapiens
AKHLAAVEER

SEQ ID NO: 29060 - protein, 10 aa, Homo sapiens
AKHLAAVEER

SEQ ID NO: 29061 - protein, 10 aa, Homo sapiens
AKHLAAVEER

SEQ ID NO: 29062 - protein, 10 aa, Homo sapiens
AKHLAAVEER

SEQ ID NO: 29063 - protein, 10 aa, Homo sapiens
AKHLAAVEER

SEQ ID NO: 29064 - protein, 10 aa, Homo sapiens
AKHLAAVEER

SEQ ID NO: 29065 - protein, 10 aa, Homo sapiens
AKHLAAVEER

SEQ ID NO: 29066 - protein, 15 aa, Homo sapiens
VASAAAKSALEEFSK

SEQ ID NO: 29067 - protein, 7 aa, Homo sapiens
KVEEAAK

SEQ ID NO: 29068 - protein, 6 aa, Homo sapiens
KTKVER

SEQ ID NO: 29069 - protein, 5 aa, Homo sapiens
TKVER

SEQ ID NO: 29070 - protein, 6 aa, Homo sapiens
KTKVER

SEQ ID NO: 29071 - protein, 5 aa, Homo sapiens
TKVER

SEQ ID NO: 29072 - protein, 13 aa, Homo sapiens
EGGGAIEEEAKEK

SEQ ID NO: 29073 - protein, 6 aa, Homo sapiens
EPKEPR

SEQ ID NO: 29074 - protein, 6 aa, Homo sapiens
EPKEPR

SEQ ID NO: 29075 - protein, 6 aa, Homo sapiens
EPKEPR

SEQ ID NO: 29076 - protein, 6 aa, Homo sapiens
EPKEPR

SEQ ID NO: 29077 - protein, 10 aa, Homo sapiens
VEGQATDEKK

SEQ ID NO: 29078 - protein, 6 aa, Homo sapiens
EPKEPR

SEQ ID NO: 29079 - protein, 10 aa, Homo sapiens
VEGQATDEKK

SEQ ID NO: 29080 - protein, 10 aa, Homo sapiens
VEGQATDEKK

SEQ ID NO: 29081 - protein, 10 aa, Homo sapiens
VEGQATDEKK

SEQ ID NO: 29082 - protein, 10 aa, Homo sapiens
VEGQATDEKK

SEQ ID NO: 29083 - protein, 10 aa, Homo sapiens
VEGQATDEKK

SEQ ID NO: 29084 - protein, 10 aa, Homo sapiens
VEGQATDEKK

SEQ ID NO: 29085 - protein, 6 aa, Homo sapiens
EPKEPR

SEQ ID NO: 29086 - protein, 10 aa, Homo sapiens
VEGQATDEKK

SEQ ID NO: 29087 - protein, 6 aa, Homo sapiens
EPKEPR

SEQ ID NO: 29088 - protein, 10 aa, Homo sapiens
VEGQATDEKK

SEQ ID NO: 29089 - protein, 6 aa, Homo sapiens
EPKEPR

SEQ ID NO: 29090 - protein, 5 aa, Homo sapiens
TKVER

SEQ ID NO: 29091 - protein, 6 aa, Homo sapiens
KNVPSK

SEQ ID NO: 29092 - protein, 6 aa, Homo sapiens
KNVPSK

SEQ ID NO: 29093 - protein, 5 aa, Homo sapiens
TKVER

SEQ ID NO: 29094 - protein, 6 aa, Homo sapiens
KTKVER

SEQ ID NO: 29095 - protein, 6 aa, Homo sapiens
NYTDKR

SEQ ID NO: 29096 - protein, 13 aa, Homo sapiens
DALVLHKVLLETR

SEQ ID NO: 29097 - protein, 6 aa, Homo sapiens
NYTDKR

SEQ ID NO: 29098 - protein, 5 aa, Homo sapiens
KFLEK

SEQ ID NO: 29099 - protein, 5 aa, Homo sapiens
KFLEK

SEQ ID NO: 29100 - protein, 5 aa, Homo sapiens
KFLEK

SEQ ID NO: 29101 - protein, 5 aa, Homo sapiens
KFLEK

SEQ ID NO: 29102 - protein, 5 aa, Homo sapiens
KFLEK

SEQ ID NO: 29103 - protein, 5 aa, Homo sapiens
KFLEK

SEQ ID NO: 29104 - protein, 5 aa, Homo sapiens
KFLEK

SEQ ID NO: 29105 - protein, 5 aa, Homo sapiens
KFLEK

SEQ ID NO: 29106 - protein, 5 aa, Homo sapiens
KFLEK

SEQ ID NO: 29107 - protein, 5 aa, Homo sapiens
KFLEK

SEQ ID NO: 29108 - protein, 5 aa, Homo sapiens
KFLEK

SEQ ID NO: 29109 - protein, 5 aa, Homo sapiens
KFLEK

SEQ ID NO: 29110 - protein, 5 aa, Homo sapiens
KFLEK

SEQ ID NO: 29111 - protein, 5 aa, Homo sapiens
KFLEK

SEQ ID NO: 29112 - protein, 5 aa, Homo sapiens
KFLEK

SEQ ID NO: 29113 - protein, 5 aa, Homo sapiens
KFLEK

SEQ ID NO: 29114 - protein, 5 aa, Homo sapiens
KFLEK

SEQ ID NO: 29115 - protein, 5 aa, Homo sapiens
KFLEK

SEQ ID NO: 29116 - protein, 5 aa, Homo sapiens
KFLEK

SEQ ID NO: 29117 - protein, 5 aa, Homo sapiens
KFLEK

SEQ ID NO: 29118 - protein, 5 aa, Homo sapiens
KFLEK

SEQ ID NO: 29119 - protein, 5 aa, Homo sapiens
KFLEK

SEQ ID NO: 29120 - protein, 5 aa, Homo sapiens
KFLEK

SEQ ID NO: 29121 - protein, 12 aa, Homo sapiens
LISELFQKLPSK

SEQ ID NO: 29122 - protein, 23 aa, Homo sapiens
LISELFQKLPSKVQYPDYYAIIK

SEQ ID NO: 29123 - protein, 23 aa, Homo sapiens
LISELFQKLPSKVQYPDYYAIIK

SEQ ID NO: 29124 - protein, 23 aa, Homo sapiens
LISELFQKLPSKVQYPDYYAIIK

SEQ ID NO: 29125 - protein, 23 aa, Homo sapiens
LISELFQKLPSKVQYPDYYAIIK

SEQ ID NO: 29126 - protein, 23 aa, Homo sapiens
LISELFQKLPSKVQYPDYYAIIK

SEQ ID NO: 29127 - protein, 11 aa, Homo sapiens
EPIDLKTIAQR

SEQ ID NO: 29128 - protein, 12 aa, Homo sapiens
LISELFQKLPSK

SEQ ID NO: 29129 - protein, 12 aa, Homo sapiens
LISELFQKLPSK

SEQ ID NO: 29130 - protein, 11 aa, Homo sapiens
EPIDLKTIAQR

SEQ ID NO: 29131 - protein, 11 aa, Homo sapiens
EPIDLKTIAQR

SEQ ID NO: 29132 - protein, 12 aa, Homo sapiens
LISELFQKLPSK

SEQ ID NO: 29133 - protein, 11 aa, Homo sapiens
EPIDLKTIAQR

SEQ ID NO: 29134 - protein, 11 aa, Homo sapiens
EPIDLKTIAQR

SEQ ID NO: 29135 - protein, 11 aa, Homo sapiens
EPIDLKTIAQR

SEQ ID NO: 29136 - protein, 11 aa, Homo sapiens
EPIDLKTIAQR

SEQ ID NO: 29137 - protein, 11 aa, Homo sapiens
EPIDLKTIAQR

SEQ ID NO: 29138 - protein, 12 aa, Homo sapiens
LISELFQKLPSK

SEQ ID NO: 29139 - protein, 12 aa, Homo sapiens
LISELFQKLPSK

SEQ ID NO: 29140 - protein, 12 aa, Homo sapiens
LISELFQKLPSK

SEQ ID NO: 29141 - protein, 16 aa, Homo sapiens
VGDCVFIKSHGLVRPR

SEQ ID NO: 29142 - protein, 10 aa, Homo sapiens
AAKVAEQQER

SEQ ID NO: 29143 - protein, 10 aa, Homo sapiens
AAKVAEQQER

SEQ ID NO: 29144 - protein, 10 aa, Homo sapiens
AAKVAEQQER

SEQ ID NO: 29145 - protein, 7 aa, Homo sapiens
KNVENNR

SEQ ID NO: 29146 - protein, 7 aa, Homo sapiens
KNVENNR

SEQ ID NO: 29147 - protein, 7 aa, Homo sapiens
KNVENNR

SEQ ID NO: 29148 - protein, 7 aa, Homo sapiens
KNVENNR

SEQ ID NO: 29149 - protein, 10 aa, Homo sapiens
AAKVAEQQER

SEQ ID NO: 29150 - protein, 10 aa, Homo sapiens
AAKVAEQQER

SEQ ID NO: 29151 - protein, 5 aa, Homo sapiens
KELAR

SEQ ID NO: 29152 - protein, 6 aa, Homo sapiens
KKELAR

SEQ ID NO: 29153 - protein, 8 aa, Homo sapiens
NPTSKYYR

SEQ ID NO: 29154 - protein, 5 aa, Homo sapiens
LKLSR

SEQ ID NO: 29155 - protein, 6 aa, Homo sapiens
KKELAR

SEQ ID NO: 29156 - protein, 4 aa, Homo sapiens
KNIR

SEQ ID NO: 29157 - protein, 23 aa, Homo sapiens
RDDIEDGDSMISSATSDTGSAKR

SEQ ID NO: 29158 - protein, 23 aa, Homo sapiens
RDDIEDGDSMISSATSDTGSAKR

SEQ ID NO: 29159 - protein, 23 aa, Homo sapiens
RDDIEDGDSMISSATSDTGSAKR

SEQ ID NO: 29160 - protein, 23 aa, Homo sapiens
RDDIEDGDSMISSATSDTGSAKR

SEQ ID NO: 29161 - protein, 23 aa, Homo sapiens
RDDIEDGDSMISSATSDTGSAKR

SEQ ID NO: 29162 - protein, 6 aa, Homo sapiens
YSAKTK

SEQ ID NO: 29163 - protein, 19 aa, Homo sapiens
EAEKSEDSSGAAGLSGLHR

SEQ ID NO: 29164 - protein, 6 aa, Homo sapiens
YSAKTK

SEQ ID NO: 29165 - protein, 6 aa, Homo sapiens
KEKLPK

SEQ ID NO: 29166 - protein, 15 aa, Homo sapiens
KINMSGYILFSSEMR

SEQ ID NO: 29167 - protein, 15 aa, Homo sapiens
KINMSGYILFSSEMR

SEQ ID NO: 29168 - protein, 15 aa, Homo sapiens
KINMSGYILFSSEMR

SEQ ID NO: 29169 - protein, 19 aa, Homo sapiens
NNQGQLIAEPFYHLPSKKK

SEQ ID NO: 29170 - protein, 5 aa, Homo sapiens
EEEKR

SEQ ID NO: 29171 - protein, 6 aa, Homo sapiens
REEEKR

SEQ ID NO: 29172 - protein, 5 aa, Homo sapiens
EEEKR

SEQ ID NO: 29173 - protein, 5 aa, Homo sapiens
LKLSR

SEQ ID NO: 29174 - protein, 11 aa, Homo sapiens
VLKLQQVMQAK

SEQ ID NO: 29175 - protein, 6 aa, Homo sapiens
KKELAR

SEQ ID NO: 29176 - protein, 11 aa, Homo sapiens
VLKLQQVMQAK

SEQ ID NO: 29177 - protein, 23 aa, Homo sapiens
RDDIEDGDSMISSATSDTGSAKR

SEQ ID NO: 29178 - protein, 23 aa, Homo sapiens
LISELFQKLPSKVQYPDYYAIIK

SEQ ID NO: 29179 - protein, 23 aa, Homo sapiens
LISELFQKLPSKVQYPDYYAIIK

SEQ ID NO: 29180 - protein, 23 aa, Homo sapiens
LISELFQKLPSKVQYPDYYAIIK

SEQ ID NO: 29181 - protein, 23 aa, Homo sapiens
LISELFQKLPSKVQYPDYYAIIK

SEQ ID NO: 29182 - protein, 23 aa, Homo sapiens
LISELFQKLPSKVQYPDYYAIIK

SEQ ID NO: 29183 - protein, 23 aa, Homo sapiens
LISELFQKLPSKVQYPDYYAIIK

SEQ ID NO: 29184 - protein, 23 aa, Homo sapiens
LISELFQKLPSKVQYPDYYAIIK

SEQ ID NO: 29185 - protein, 23 aa, Homo sapiens
LISELFQKLPSKVQYPDYYAIIK

SEQ ID NO: 29186 - protein, 23 aa, Homo sapiens
LISELFQKLPSKVQYPDYYAIIK

SEQ ID NO: 29187 - protein, 9 aa, Homo sapiens
LPKEIEEDK

SEQ ID NO: 29188 - protein, 10 aa, Homo sapiens
HLHNDVEKER

SEQ ID NO: 29189 - protein, 10 aa, Homo sapiens
HLHNDVEKER

SEQ ID NO: 29190 - protein, 9 aa, Homo sapiens
LPKEIEEDK

SEQ ID NO: 29191 - protein, 23 aa, Homo sapiens
RDDIEDGDSMISSATSDTGSAKR

SEQ ID NO: 29192 - protein, 23 aa, Homo sapiens
RDDIEDGDSMISSATSDTGSAKR

SEQ ID NO: 29193 - protein, 12 aa, Homo sapiens
MKILFNVVLEAR

SEQ ID NO: 29194 - protein, 12 aa, Homo sapiens
MKILFNVVLEAR

SEQ ID NO: 29195 - protein, 6 aa, Homo sapiens
KKELAR

SEQ ID NO: 29196 - protein, 6 aa, Homo sapiens
REEEKR

SEQ ID NO: 29197 - protein, 9 aa, Homo sapiens
EEEKREAEK

SEQ ID NO: 29198 - protein, 9 aa, Homo sapiens
EIEEDKLKR

SEQ ID NO: 29199 - protein, 9 aa, Homo sapiens
EIEEDKLKR

SEQ ID NO: 29200 - protein, 9 aa, Homo sapiens
EIEEDKLKR

SEQ ID NO: 29201 - protein, 9 aa, Homo sapiens
EIEEDKLKR

SEQ ID NO: 29202 - protein, 14 aa, Homo sapiens
SKGAHTTMADALWR

SEQ ID NO: 29203 - protein, 7 aa, Homo sapiens
KNVENNR

SEQ ID NO: 29204 - protein, 7 aa, Homo sapiens
KNVENNR

SEQ ID NO: 29205 - protein, 7 aa, Homo sapiens
KNVENNR

SEQ ID NO: 29206 - protein, 7 aa, Homo sapiens
KNVENNR

SEQ ID NO: 29207 - protein, 7 aa, Homo sapiens
KNVENNR

SEQ ID NO: 29208 - protein, 7 aa, Homo sapiens
KNVENNR

SEQ ID NO: 29209 - protein, 7 aa, Homo sapiens
KAEYEER

SEQ ID NO: 29210 - protein, 5 aa, Homo sapiens
LKLSR

SEQ ID NO: 29211 - protein, 5 aa, Homo sapiens
LKLSR

SEQ ID NO: 29212 - protein, 11 aa, Homo sapiens
YNVPNSAIYKR

SEQ ID NO: 29213 - protein, 11 aa, Homo sapiens
YNVPNSAIYKR

SEQ ID NO: 29214 - protein, 12 aa, Homo sapiens
RYNVPNSAIYKR

SEQ ID NO: 29215 - protein, 11 aa, Homo sapiens
YNVPNSAIYKR

SEQ ID NO: 29216 - protein, 12 aa, Homo sapiens
RYNVPNSAIYKR

SEQ ID NO: 29217 - protein, 12 aa, Homo sapiens
RYNVPNSAIYKR

SEQ ID NO: 29218 - protein, 11 aa, Homo sapiens
VLKLQQVMQAK

SEQ ID NO: 29219 - protein, 11 aa, Homo sapiens
YNVPNSAIYKR

SEQ ID NO: 29220 - protein, 12 aa, Homo sapiens
VLKLQQVMQAKK

SEQ ID NO: 29221 - protein, 11 aa, Homo sapiens
VLKLQQVMQAK

SEQ ID NO: 29222 - protein, 11 aa, Homo sapiens
VLKLQQVMQAK

SEQ ID NO: 29223 - protein, 11 aa, Homo sapiens
VLKLQQVMQAK

SEQ ID NO: 29224 - protein, 11 aa, Homo sapiens
VLKLQQVMQAK

SEQ ID NO: 29225 - protein, 11 aa, Homo sapiens
YNVPNSAIYKR

SEQ ID NO: 29226 - protein, 11 aa, Homo sapiens
YNVPNSAIYKR

SEQ ID NO: 29227 - protein, 11 aa, Homo sapiens
VLKLQQVMQAK

SEQ ID NO: 29228 - protein, 12 aa, Homo sapiens
RYNVPNSAIYKR

SEQ ID NO: 29229 - protein, 11 aa, Homo sapiens
YNVPNSAIYKR

SEQ ID NO: 29230 - protein, 12 aa, Homo sapiens
RYNVPNSAIYKR

SEQ ID NO: 29231 - protein, 11 aa, Homo sapiens
VLKLQQVMQAK

SEQ ID NO: 29232 - protein, 11 aa, Homo sapiens
VLKLQQVMQAK

SEQ ID NO: 29233 - protein, 12 aa, Homo sapiens
RYNVPNSAIYKR

SEQ ID NO: 29234 - protein, 11 aa, Homo sapiens
YNVPNSAIYKR

SEQ ID NO: 29235 - protein, 5 aa, Homo sapiens
LKLSR

SEQ ID NO: 29236 - protein, 5 aa, Homo sapiens
KELAR

SEQ ID NO: 29237 - protein, 6 aa, Homo sapiens
KKELAR

SEQ ID NO: 29238 - protein, 15 aa, Homo sapiens
LTGPSHSKGSLGEER

SEQ ID NO: 29239 - protein, 8 aa, Homo sapiens
NPTSKYYR

SEQ ID NO: 29240 - protein, 8 aa, Homo sapiens
NPTSKYYR

SEQ ID NO: 29241 - protein, 8 aa, Homo sapiens
NPTSKYYR

SEQ ID NO: 29242 - protein, 8 aa, Homo sapiens
NPTSKYYR

SEQ ID NO: 29243 - protein, 8 aa, Homo sapiens
NPTSKYYR

SEQ ID NO: 29244 - protein, 15 aa, Homo sapiens
LTGPSHSKGSLGEER

SEQ ID NO: 29245 - protein, 8 aa, Homo sapiens
NPTSKYYR

SEQ ID NO: 29246 - protein, 8 aa, Homo sapiens
NPTSKYYR

SEQ ID NO: 29247 - protein, 8 aa, Homo sapiens
NPTSKYYR

SEQ ID NO: 29248 - protein, 8 aa, Homo sapiens
DYKDEQGR

SEQ ID NO: 29249 - protein, 11 aa, Homo sapiens
YNVPNSAIYKR

SEQ ID NO: 29250 - protein, 11 aa, Homo sapiens
YNVPNSAIYKR

SEQ ID NO: 29251 - protein, 7 aa, Homo sapiens
KAEYEER

SEQ ID NO: 29252 - protein, 7 aa, Homo sapiens
KAEYEER

SEQ ID NO: 29253 - protein, 7 aa, Homo sapiens
NLETAKK

SEQ ID NO: 29254 - protein, 7 aa, Homo sapiens
NLETAKK

SEQ ID NO: 29255 - protein, 7 aa, Homo sapiens
NLETAKK

SEQ ID NO: 29256 - protein, 17 aa, Homo sapiens
AVIKAQHPDYSFGELSR

SEQ ID NO: 29257 - protein, 15 aa, Homo sapiens
LTGPSHSKGSLGEER

SEQ ID NO: 29258 - protein, 8 aa, Homo sapiens
NPTSKYYR

SEQ ID NO: 29259 - protein, 8 aa, Homo sapiens
NPTSKYYR

SEQ ID NO: 29260 - protein, 8 aa, Homo sapiens
DYKDEQGR

SEQ ID NO: 29261 - protein, 11 aa, Homo sapiens
YNVPNSAIYKR

SEQ ID NO: 29262 - protein, 11 aa, Homo sapiens
YNVPNSAIYKR

SEQ ID NO: 29263 - protein, 10 aa, Homo sapiens
AAKVAEQQER

SEQ ID NO: 29264 - protein, 7 aa, Homo sapiens
KNVENNR

SEQ ID NO: 29265 - protein, 12 aa, Homo sapiens
LKLIANNTTVER

SEQ ID NO: 29266 - protein, 12 aa, Homo sapiens
LKLIANNTTVER

SEQ ID NO: 29267 - protein, 12 aa, Homo sapiens
LKLIANNTTVER

SEQ ID NO: 29268 - protein, 9 aa, Homo sapiens
EGSPANWKR

SEQ ID NO: 29269 - protein, 9 aa, Homo sapiens
EGSPANWKR

SEQ ID NO: 29270 - protein, 9 aa, Homo sapiens
EGSPANWKR

SEQ ID NO: 29271 - protein, 9 aa, Homo sapiens
EGSPANWKR

SEQ ID NO: 29272 - protein, 9 aa, Homo sapiens
KEKLPQVTR

SEQ ID NO: 29273 - protein, 9 aa, Homo sapiens
KEKLPQVTR

SEQ ID NO: 29274 - protein, 9 aa, Homo sapiens
EGSPANWKR

SEQ ID NO: 29275 - protein, 9 aa, Homo sapiens
EGSPANWKR

SEQ ID NO: 29276 - protein, 9 aa, Homo sapiens
KEKLPQVTR

SEQ ID NO: 29277 - protein, 9 aa, Homo sapiens
EGSPANWKR

SEQ ID NO: 29278 - protein, 20 aa, Homo sapiens
EKLTELMFEHYNIPAFFLCK

SEQ ID NO: 29279 - protein, 20 aa, Homo sapiens
EKLTELMFEHYNIPAFFLCK

SEQ ID NO: 29280 - protein, 20 aa, Homo sapiens
EKLTELMFEHYNIPAFFLCK

SEQ ID NO: 29281 - protein, 20 aa, Homo sapiens
EKLTELMFEHYNIPAFFLCK

SEQ ID NO: 29282 - protein, 20 aa, Homo sapiens
EKLTELMFEHYNIPAFFLCK

SEQ ID NO: 29283 - protein, 13 aa, Homo sapiens
QEYEEGGKQCVER

SEQ ID NO: 29284 - protein, 20 aa, Homo sapiens
EKLTELMFEHYNIPAFFLCK

SEQ ID NO: 29285 - protein, 13 aa, Homo sapiens
QEYEEGGKQCVER

SEQ ID NO: 29286 - protein, 13 aa, Homo sapiens
QEYEEGGKQCVER

SEQ ID NO: 29287 - protein, 13 aa, Homo sapiens
QEYEEGGKQCVER

SEQ ID NO: 29288 - protein, 20 aa, Homo sapiens
EKLTELMFEHYNIPAFFLCK

SEQ ID NO: 29289 - protein, 13 aa, Homo sapiens
QEYEEGGKQCVER

SEQ ID NO: 29290 - protein, 13 aa, Homo sapiens
QEYEEGGKQCVER

SEQ ID NO: 29291 - protein, 13 aa, Homo sapiens
QEYEEGGKQCVER

SEQ ID NO: 29292 - protein, 13 aa, Homo sapiens
QEYEEGGKQCVER

SEQ ID NO: 29293 - protein, 6 aa, Homo sapiens
GFKYLR

SEQ ID NO: 29294 - protein, 6 aa, Homo sapiens
GFKYLR

SEQ ID NO: 29295 - protein, 7 aa, Homo sapiens
KEKAQDR

SEQ ID NO: 29296 - protein, 16 aa, Homo sapiens
VIQAGMFDQKSSSHER

SEQ ID NO: 29297 - protein, 16 aa, Homo sapiens
VIQAGMFDQKSSSHER

SEQ ID NO: 29298 - protein, 8 aa, Homo sapiens
EQKKENER

SEQ ID NO: 29299 - protein, 8 aa, Homo sapiens
EQKKENER

SEQ ID NO: 29300 - protein, 8 aa, Homo sapiens
EQKKENER

SEQ ID NO: 29301 - protein, 7 aa, Homo sapiens
VKIKLGR

SEQ ID NO: 29302 - protein, 8 aa, Homo sapiens
SVTGKIQK

SEQ ID NO: 29303 - protein, 8 aa, Homo sapiens
SVTGKIQK

SEQ ID NO: 29304 - protein, 8 aa, Homo sapiens
SVTGKIQK

SEQ ID NO: 29305 - protein, 5 aa, Homo sapiens
LKGGR

SEQ ID NO: 29306 - protein, 5 aa, Homo sapiens
LKGGR

SEQ ID NO: 29307 - protein, 5 aa, Homo sapiens
NHKYR

SEQ ID NO: 29308 - protein, 5 aa, Homo sapiens
NHKYR

SEQ ID NO: 29309 - protein, 5 aa, Homo sapiens
NHKYR

SEQ ID NO: 29310 - protein, 10 aa, Homo sapiens
LDGTTKAEDR

SEQ ID NO: 29311 - protein, 5 aa, Homo sapiens
NHKYR

SEQ ID NO: 29312 - protein, 5 aa, Homo sapiens
NHKYR

SEQ ID NO: 29313 - protein, 5 aa, Homo sapiens
NHKYR

SEQ ID NO: 29314 - protein, 5 aa, Homo sapiens
NHKYR

SEQ ID NO: 29315 - protein, 5 aa, Homo sapiens
NHKYR

SEQ ID NO: 29316 - protein, 7 aa, Homo sapiens
IRNHKYR

SEQ ID NO: 29317 - protein, 7 aa, Homo sapiens
IRNHKYR

SEQ ID NO: 29318 - protein, 7 aa, Homo sapiens
IRNHKYR

SEQ ID NO: 29319 - protein, 7 aa, Homo sapiens
IRNHKYR

SEQ ID NO: 29320 - protein, 5 aa, Homo sapiens
KIKER

SEQ ID NO: 29321 - protein, 7 aa, Homo sapiens
KPVDFKK

SEQ ID NO: 29322 - protein, 5 aa, Homo sapiens
NHKYR

SEQ ID NO: 29323 - protein, 6 aa, Homo sapiens
KPVDFK

SEQ ID NO: 29324 - protein, 6 aa, Homo sapiens
KPVDFK

SEQ ID NO: 29325 - protein, 5 aa, Homo sapiens
KIKER

SEQ ID NO: 29326 - protein, 10 aa, Homo sapiens
ASGKFELLDR

SEQ ID NO: 29327 - protein, 6 aa, Homo sapiens
GFKYLR

SEQ ID NO: 29328 - protein, 17 aa, Homo sapiens
KKIPDPDSDDVSEVDAR

SEQ ID NO: 29329 - protein, 17 aa, Homo sapiens
KKIPDPDSDDVSEVDAR

SEQ ID NO: 29330 - protein, 7 aa, Homo sapiens
KEKAQDR

SEQ ID NO: 29331 - protein, 7 aa, Homo sapiens
KEKAQDR

SEQ ID NO: 29332 - protein, 7 aa, Homo sapiens
KEKAQDR

SEQ ID NO: 29333 - protein, 8 aa, Homo sapiens
QQKIEQER

SEQ ID NO: 29334 - protein, 8 aa, Homo sapiens
QQKIEQER

SEQ ID NO: 29335 - protein, 8 aa, Homo sapiens
QQKIEQER

SEQ ID NO: 29336 - protein, 9 aa, Homo sapiens
SRDKDDESK

SEQ ID NO: 29337 - protein, 9 aa, Homo sapiens
SRDKDDESK

SEQ ID NO: 29338 - protein, 9 aa, Homo sapiens
SRDKDDESK

SEQ ID NO: 29339 - protein, 8 aa, Homo sapiens
EQKKENER

SEQ ID NO: 29340 - protein, 5 aa, Homo sapiens
IEKER

SEQ ID NO: 29341 - protein, 8 aa, Homo sapiens
EQKKENER

SEQ ID NO: 29342 - protein, 8 aa, Homo sapiens
EQKKENER

SEQ ID NO: 29343 - protein, 5 aa, Homo sapiens
IEKER

SEQ ID NO: 29344 - protein, 5 aa, Homo sapiens
IEKER

SEQ ID NO: 29345 - protein, 8 aa, Homo sapiens
EQKKENER

SEQ ID NO: 29346 - protein, 5 aa, Homo sapiens
IEKER

SEQ ID NO: 29347 - protein, 22 aa, Homo sapiens
KDLYANTVLSGGTTMYPGIADR

SEQ ID NO: 29348 - protein, 22 aa, Homo sapiens
KDLYANTVLSGGTTMYPGIADR

SEQ ID NO: 29349 - protein, 22 aa, Homo sapiens
KDLYANTVLSGGTTMYPGIADR

SEQ ID NO: 29350 - protein, 22 aa, Homo sapiens
KDLYANTVLSGGTTMYPGIADR

SEQ ID NO: 29351 - protein, 22 aa, Homo sapiens
KDLYANTVLSGGTTMYPGIADR

SEQ ID NO: 29352 - protein, 22 aa, Homo sapiens
KDLYANTVLSGGTTMYPGIADR

SEQ ID NO: 29353 - protein, 22 aa, Homo sapiens
KDLYANTVLSGGTTMYPGIADR

SEQ ID NO: 29354 - protein, 22 aa, Homo sapiens
KDLYANTVLSGGTTMYPGIADR

SEQ ID NO: 29355 - protein, 22 aa, Homo sapiens
KDLYANTVLSGGTTMYPGIADR

SEQ ID NO: 29356 - protein, 22 aa, Homo sapiens
KDLYANTVLSGGTTMYPGIADR

SEQ ID NO: 29357 - protein, 11 aa, Homo sapiens
LDMEIDGQKLR

SEQ ID NO: 29358 - protein, 11 aa, Homo sapiens
LDMEIDGQKLR

SEQ ID NO: 29359 - protein, 11 aa, Homo sapiens
LDMEIDGQKLR

SEQ ID NO: 29360 - protein, 11 aa, Homo sapiens
LDMEIDGQKLR

SEQ ID NO: 29361 - protein, 8 aa, Homo sapiens
YDATKQKR

SEQ ID NO: 29362 - protein, 8 aa, Homo sapiens
YDATKQKR

SEQ ID NO: 29363 - protein, 19 aa, Homo sapiens
KRPAPQQIQQVQQQAVQNR

SEQ ID NO: 29364 - protein, 7 aa, Homo sapiens
KFSSFFK

SEQ ID NO: 29365 - protein, 9 aa, Homo sapiens
VMAAIEKVR

SEQ ID NO: 29366 - protein, 9 aa, Homo sapiens
VMAAIEKVR

SEQ ID NO: 29367 - protein, 9 aa, Homo sapiens
VMAAIEKVR

SEQ ID NO: 29368 - protein, 9 aa, Homo sapiens
VMAAIEKVR

SEQ ID NO: 29369 - protein, 9 aa, Homo sapiens
VMAAIEKVR

SEQ ID NO: 29370 - protein, 5 aa, Homo sapiens
HQEKK

SEQ ID NO: 29371 - protein, 5 aa, Homo sapiens
HQEKK

SEQ ID NO: 29372 - protein, 5 aa, Homo sapiens
HQEKK

SEQ ID NO: 29373 - protein, 5 aa, Homo sapiens
HQEKK

SEQ ID NO: 29374 - protein, 5 aa, Homo sapiens
HQEKK

SEQ ID NO: 29375 - protein, 5 aa, Homo sapiens
HQEKK

SEQ ID NO: 29376 - protein, 6 aa, Homo sapiens
HQEKKR

SEQ ID NO: 29377 - protein, 5 aa, Homo sapiens
HQEKK

SEQ ID NO: 29378 - protein, 6 aa, Homo sapiens
KRQEER

SEQ ID NO: 29379 - protein, 6 aa, Homo sapiens
KRQEER

SEQ ID NO: 29380 - protein, 6 aa, Homo sapiens
KRQEER

SEQ ID NO: 29381 - protein, 6 aa, Homo sapiens
KRQEER

SEQ ID NO: 29382 - protein, 6 aa, Homo sapiens
KRQEER

SEQ ID NO: 29383 - protein, 6 aa, Homo sapiens
KRQEER

SEQ ID NO: 29384 - protein, 6 aa, Homo sapiens
KRQEER

SEQ ID NO: 29385 - protein, 14 aa, Homo sapiens
FLESTDSFNNELKR

SEQ ID NO: 29386 - protein, 14 aa, Homo sapiens
FLESTDSFNNELKR

SEQ ID NO: 29387 - protein, 15 aa, Homo sapiens
KFLESTDSFNNELKR

SEQ ID NO: 29388 - protein, 14 aa, Homo sapiens
FLESTDSFNNELKR

SEQ ID NO: 29389 - protein, 15 aa, Homo sapiens
KFLESTDSFNNELKR

SEQ ID NO: 29390 - protein, 14 aa, Homo sapiens
FLESTDSFNNELKR

SEQ ID NO: 29391 - protein, 15 aa, Homo sapiens
KFLESTDSFNNELKR

SEQ ID NO: 29392 - protein, 14 aa, Homo sapiens
FLESTDSFNNELKR

SEQ ID NO: 29393 - protein, 14 aa, Homo sapiens
FLESTDSFNNELKR

SEQ ID NO: 29394 - protein, 15 aa, Homo sapiens
KFLESTDSFNNELKR

SEQ ID NO: 29395 - protein, 14 aa, Homo sapiens
FLESTDSFNNELKR

SEQ ID NO: 29396 - protein, 14 aa, Homo sapiens
FLESTDSFNNELKR

SEQ ID NO: 29397 - protein, 15 aa, Homo sapiens
KFLESTDSFNNELKR

SEQ ID NO: 29398 - protein, 15 aa, Homo sapiens
KFLESTDSFNNELKR

SEQ ID NO: 29399 - protein, 15 aa, Homo sapiens
KFLESTDSFNNELKR

SEQ ID NO: 29400 - protein, 15 aa, Homo sapiens
KFLESTDSFNNELKR

SEQ ID NO: 29401 - protein, 11 aa, Homo sapiens
VEGKLLDDPSK

SEQ ID NO: 29402 - protein, 11 aa, Homo sapiens
VEGKLLDDPSK

SEQ ID NO: 29403 - protein, 11 aa, Homo sapiens
VEGKLLDDPSK

SEQ ID NO: 29404 - protein, 11 aa, Homo sapiens
VEGKLLDDPSK

SEQ ID NO: 29405 - protein, 11 aa, Homo sapiens
VEGKLLDDPSK

SEQ ID NO: 29406 - protein, 7 aa, Homo sapiens
KVQEAAR

SEQ ID NO: 29407 - protein, 7 aa, Homo sapiens
KVQEAAR

SEQ ID NO: 29408 - protein, 15 aa, Homo sapiens
VASAAAKAALEEFSR

SEQ ID NO: 29409 - protein, 15 aa, Homo sapiens
VASAAAKAALEEFSR

SEQ ID NO: 29410 - protein, 10 aa, Homo sapiens
AKHLAAVEER

SEQ ID NO: 29411 - protein, 10 aa, Homo sapiens
AKHLAAVEER

SEQ ID NO: 29412 - protein, 10 aa, Homo sapiens
AKHLAAVEER

SEQ ID NO: 29413 - protein, 10 aa, Homo sapiens
AKHLAAVEER

SEQ ID NO: 29414 - protein, 10 aa, Homo sapiens
AKHLAAVEER

SEQ ID NO: 29415 - protein, 10 aa, Homo sapiens
AKHLAAVEER

SEQ ID NO: 29416 - protein, 10 aa, Homo sapiens
AKHLAAVEER

SEQ ID NO: 29417 - protein, 10 aa, Homo sapiens
AKHLAAVEER

SEQ ID NO: 29418 - protein, 10 aa, Homo sapiens
AKHLAAVEER

SEQ ID NO: 29419 - protein, 10 aa, Homo sapiens
AKHLAAVEER

SEQ ID NO: 29420 - protein, 10 aa, Homo sapiens
AKHLAAVEER

SEQ ID NO: 29421 - protein, 10 aa, Homo sapiens
AKHLAAVEER

SEQ ID NO: 29422 - protein, 10 aa, Homo sapiens
AKHLAAVEER

SEQ ID NO: 29423 - protein, 10 aa, Homo sapiens
AKHLAAVEER

SEQ ID NO: 29424 - protein, 10 aa, Homo sapiens
AKHLAAVEER

SEQ ID NO: 29425 - protein, 10 aa, Homo sapiens
AKHLAAVEER

SEQ ID NO: 29426 - protein, 10 aa, Homo sapiens
AKHLAAVEER

SEQ ID NO: 29427 - protein, 10 aa, Homo sapiens
AKHLAAVEER

SEQ ID NO: 29428 - protein, 10 aa, Homo sapiens
AKHLAAVEER

SEQ ID NO: 29429 - protein, 10 aa, Homo sapiens
AKHLAAVEER

SEQ ID NO: 29430 - protein, 10 aa, Homo sapiens
AKHLAAVEER

SEQ ID NO: 29431 - protein, 10 aa, Homo sapiens
AKHLAAVEER

SEQ ID NO: 29432 - protein, 15 aa, Homo sapiens
VASAAAKAALEEFSR

SEQ ID NO: 29433 - protein, 15 aa, Homo sapiens
VASAAAKAALEEFSR

SEQ ID NO: 29434 - protein, 15 aa, Homo sapiens
VASAAAKAALEEFSR

SEQ ID NO: 29435 - protein, 15 aa, Homo sapiens
VASAAAKAALEEFSR

SEQ ID NO: 29436 - protein, 15 aa, Homo sapiens
VASAAAKAALEEFSR

SEQ ID NO: 29437 - protein, 6 aa, Homo sapiens
KPVSFR

SEQ ID NO: 29438 - protein, 6 aa, Homo sapiens
KPVSFR

SEQ ID NO: 29439 - protein, 6 aa, Homo sapiens
KPVSFR

SEQ ID NO: 29440 - protein, 6 aa, Homo sapiens
KPVSFR

SEQ ID NO: 29441 - protein, 11 aa, Homo sapiens
SKTPEIYLAYR

SEQ ID NO: 29442 - protein, 7 aa, Homo sapiens
KASANAR

SEQ ID NO: 29443 - protein, 7 aa, Homo sapiens
KASANAR

SEQ ID NO: 29444 - protein, 15 aa, Homo sapiens
KIKSLVALLVETQMK

SEQ ID NO: 29445 - protein, 15 aa, Homo sapiens
KIKSLVALLVETQMK

SEQ ID NO: 29446 - protein, 15 aa, Homo sapiens
KIKSLVALLVETQMK

SEQ ID NO: 29447 - protein, 15 aa, Homo sapiens
KIKSLVALLVETQMK

SEQ ID NO: 29448 - protein, 15 aa, Homo sapiens
KIKSLVALLVETQMK

SEQ ID NO: 29449 - protein, 10 aa, Homo sapiens
AKHLAAVEER

SEQ ID NO: 29450 - protein, 14 aa, Homo sapiens
NKEKPVDLQNFGLR

SEQ ID NO: 29451 - protein, 10 aa, Homo sapiens
AKHLAAVEER

SEQ ID NO: 29452 - protein, 18 aa, Homo sapiens
SPQVPAAQQMLNFPEKNK

SEQ ID NO: 29453 - protein, 18 aa, Homo sapiens
SPQVPAAQQMLNFPEKNK

SEQ ID NO: 29454 - protein, 18 aa, Homo sapiens
SPQVPAAQQMLNFPEKNK

SEQ ID NO: 29455 - protein, 12 aa, Homo sapiens
EKPVDLQNFGLR

SEQ ID NO: 29456 - protein, 12 aa, Homo sapiens
EKPVDLQNFGLR

SEQ ID NO: 29457 - protein, 7 aa, Homo sapiens
KVQEAAR

SEQ ID NO: 29458 - protein, 7 aa, Homo sapiens
KVQEAAR

SEQ ID NO: 29459 - protein, 7 aa, Homo sapiens
KVQEAAR

SEQ ID NO: 29460 - protein, 7 aa, Homo sapiens
KVQEAAR

SEQ ID NO: 29461 - protein, 8 aa, Homo sapiens
KDGGPATK

SEQ ID NO: 29462 - protein, 7 aa, Homo sapiens
KASANAR

SEQ ID NO: 29463 - protein, 7 aa, Homo sapiens
KASANAR

SEQ ID NO: 29464 - protein, 9 aa, Homo sapiens
DRKASANAR

SEQ ID NO: 29465 - protein, 7 aa, Homo sapiens
KASANAR

SEQ ID NO: 29466 - protein, 7 aa, Homo sapiens
KASANAR

SEQ ID NO: 29467 - protein, 7 aa, Homo sapiens
KASANAR

SEQ ID NO: 29468 - protein, 18 aa, Homo sapiens
ITDHYKEYSQMQQQNTQK

SEQ ID NO: 29469 - protein, 8 aa, Homo sapiens
YKVLPTER

SEQ ID NO: 29470 - protein, 8 aa, Homo sapiens
YKVLPTER

SEQ ID NO: 29471 - protein, 8 aa, Homo sapiens
YKVLPTER

SEQ ID NO: 29472 - protein, 21 aa, Homo sapiens
TKVSSYPVALIPGQFQEYYKR

SEQ ID NO: 29473 - protein, 8 aa, Homo sapiens
YKVLPTER

SEQ ID NO: 29474 - protein, 8 aa, Homo sapiens
YKVLPTER

SEQ ID NO: 29475 - protein, 8 aa, Homo sapiens
YKVLPTER

SEQ ID NO: 29476 - protein, 8 aa, Homo sapiens
YKVLPTER

SEQ ID NO: 29477 - protein, 21 aa, Homo sapiens
TKVSSYPVALIPGQFQEYYKR

SEQ ID NO: 29478 - protein, 21 aa, Homo sapiens
TKVSSYPVALIPGQFQEYYKR

SEQ ID NO: 29479 - protein, 8 aa, Homo sapiens
YKVLPTER

SEQ ID NO: 29480 - protein, 6 aa, Homo sapiens
KDGPKR

SEQ ID NO: 29481 - protein, 6 aa, Homo sapiens
KDGPKR

SEQ ID NO: 29482 - protein, 4 aa, Homo sapiens
KVGR

SEQ ID NO: 29483 - protein, 9 aa, Homo sapiens
SKDKAATPR

SEQ ID NO: 29484 - protein, 7 aa, Homo sapiens
DKAATPR

SEQ ID NO: 29485 - protein, 11 aa, Homo sapiens
DLSHKEKLYLR

SEQ ID NO: 29486 - protein, 11 aa, Homo sapiens
DLSHKEKLYLR

SEQ ID NO: 29487 - protein, 11 aa, Homo sapiens
DLSHKEKLYLR

SEQ ID NO: 29488 - protein, 7 aa, Homo sapiens
DLSHKEK

SEQ ID NO: 29489 - protein, 7 aa, Homo sapiens
DLSHKEK

SEQ ID NO: 29490 - protein, 7 aa, Homo sapiens
KYPDLER

SEQ ID NO: 29491 - protein, 6 aa, Homo sapiens
KDGPKR

SEQ ID NO: 29492 - protein, 5 aa, Homo sapiens
KDGPK

SEQ ID NO: 29493 - protein, 6 aa, Homo sapiens
GKESNK

SEQ ID NO: 29494 - protein, 11 aa, Homo sapiens
DLSHKEKLYLR

SEQ ID NO: 29495 - protein, 8 aa, Homo sapiens
RKYPDLER

SEQ ID NO: 29496 - protein, 7 aa, Homo sapiens
KYPDLER

SEQ ID NO: 29497 - protein, 7 aa, Homo sapiens
KYPDLER

SEQ ID NO: 29498 - protein, 7 aa, Homo sapiens
DLSHKEK

SEQ ID NO: 29499 - protein, 7 aa, Homo sapiens
DLSHKEK

SEQ ID NO: 29500 - protein, 7 aa, Homo sapiens
DLSHKEK

SEQ ID NO: 29501 - protein, 8 aa, Homo sapiens
RKYPDLER

SEQ ID NO: 29502 - protein, 8 aa, Homo sapiens
RKYPDLER

SEQ ID NO: 29503 - protein, 7 aa, Homo sapiens
KYPDLER

SEQ ID NO: 29504 - protein, 7 aa, Homo sapiens
KYPDLER

SEQ ID NO: 29505 - protein, 7 aa, Homo sapiens
KYPDLER

SEQ ID NO: 29506 - protein, 6 aa, Homo sapiens
EKLYLR

SEQ ID NO: 29507 - protein, 6 aa, Homo sapiens
EKLYLR

SEQ ID NO: 29508 - protein, 6 aa, Homo sapiens
EKLYLR

SEQ ID NO: 29509 - protein, 15 aa, Homo sapiens
SDEVIDLMIKEYPAK

SEQ ID NO: 29510 - protein, 15 aa, Homo sapiens
SDEVIDLMIKEYPAK

SEQ ID NO: 29511 - protein, 15 aa, Homo sapiens
SDEVIDLMIKEYPAK

SEQ ID NO: 29512 - protein, 15 aa, Homo sapiens
SDEVIDLMIKEYPAK

SEQ ID NO: 29513 - protein, 15 aa, Homo sapiens
SDEVIDLMIKEYPAK

SEQ ID NO: 29514 - protein, 15 aa, Homo sapiens
SDEVIDLMIKEYPAK

SEQ ID NO: 29515 - protein, 15 aa, Homo sapiens
SDEVIDLMIKEYPAK

SEQ ID NO: 29516 - protein, 15 aa, Homo sapiens
SDEVIDLMIKEYPAK

SEQ ID NO: 29517 - protein, 15 aa, Homo sapiens
SDEVIDLMIKEYPAK

SEQ ID NO: 29518 - protein, 7 aa, Homo sapiens
KYPDLER

SEQ ID NO: 29519 - protein, 7 aa, Homo sapiens
KYPDLER

SEQ ID NO: 29520 - protein, 15 aa, Homo sapiens
SDEVIDLMIKEYPAK

SEQ ID NO: 29521 - protein, 7 aa, Homo sapiens
KYPDLER

SEQ ID NO: 29522 - protein, 7 aa, Homo sapiens
KYPDLER

SEQ ID NO: 29523 - protein, 7 aa, Homo sapiens
KYPDLER

SEQ ID NO: 29524 - protein, 8 aa, Homo sapiens
RKYPDLER

SEQ ID NO: 29525 - protein, 18 aa, Homo sapiens
EYPAKHAEYSVILQEKER

SEQ ID NO: 29526 - protein, 18 aa, Homo sapiens
EYPAKHAEYSVILQEKER

SEQ ID NO: 29527 - protein, 8 aa, Homo sapiens
KYPDLERR

SEQ ID NO: 29528 - protein, 7 aa, Homo sapiens
KYPDLER

SEQ ID NO: 29529 - protein, 8 aa, Homo sapiens
KYPDLERR

SEQ ID NO: 29530 - protein, 8 aa, Homo sapiens
KYPDLERR

SEQ ID NO: 29531 - protein, 7 aa, Homo sapiens
KYPDLER

SEQ ID NO: 29532 - protein, 18 aa, Homo sapiens
EYPAKHAEYSVILQEKER

SEQ ID NO: 29533 - protein, 8 aa, Homo sapiens
KYPDLERR

SEQ ID NO: 29534 - protein, 7 aa, Homo sapiens
KYPDLER

SEQ ID NO: 29535 - protein, 18 aa, Homo sapiens
EYPAKHAEYSVILQEKER

SEQ ID NO: 29536 - protein, 18 aa, Homo sapiens
EYPAKHAEYSVILQEKER

SEQ ID NO: 29537 - protein, 18 aa, Homo sapiens
EYPAKHAEYSVILQEKER

SEQ ID NO: 29538 - protein, 7 aa, Homo sapiens
KYPDLER

SEQ ID NO: 29539 - protein, 18 aa, Homo sapiens
EYPAKHAEYSVILQEKER

SEQ ID NO: 29540 - protein, 18 aa, Homo sapiens
EYPAKHAEYSVILQEKER

SEQ ID NO: 29541 - protein, 18 aa, Homo sapiens
EYPAKHAEYSVILQEKER

SEQ ID NO: 29542 - protein, 7 aa, Homo sapiens
KYPDLER

SEQ ID NO: 29543 - protein, 18 aa, Homo sapiens
EYPAKHAEYSVILQEKER

SEQ ID NO: 29544 - protein, 7 aa, Homo sapiens
KYPDLER

SEQ ID NO: 29545 - protein, 18 aa, Homo sapiens
EYPAKHAEYSVILQEKER

SEQ ID NO: 29546 - protein, 18 aa, Homo sapiens
EYPAKHAEYSVILQEKER

SEQ ID NO: 29547 - protein, 18 aa, Homo sapiens
EYPAKHAEYSVILQEKER

SEQ ID NO: 29548 - protein, 18 aa, Homo sapiens
EYPAKHAEYSVILQEKER

SEQ ID NO: 29549 - protein, 8 aa, Homo sapiens
KYPDLERR

SEQ ID NO: 29550 - protein, 7 aa, Homo sapiens
KYPDLER

SEQ ID NO: 29551 - protein, 8 aa, Homo sapiens
KYPDLERR

SEQ ID NO: 29552 - protein, 18 aa, Homo sapiens
EYPAKHAEYSVILQEKER

SEQ ID NO: 29553 - protein, 18 aa, Homo sapiens
EYPAKHAEYSVILQEKER

SEQ ID NO: 29554 - protein, 7 aa, Homo sapiens
KYPDLER

SEQ ID NO: 29555 - protein, 7 aa, Homo sapiens
KYPDLER

SEQ ID NO: 29556 - protein, 7 aa, Homo sapiens
KYPDLER

SEQ ID NO: 29557 - protein, 18 aa, Homo sapiens
EYPAKHAEYSVILQEKER

SEQ ID NO: 29558 - protein, 7 aa, Homo sapiens
KYPDLER

SEQ ID NO: 29559 - protein, 7 aa, Homo sapiens
KYPDLER

SEQ ID NO: 29560 - protein, 7 aa, Homo sapiens
KYPDLER

SEQ ID NO: 29561 - protein, 7 aa, Homo sapiens
KYPDLER

SEQ ID NO: 29562 - protein, 7 aa, Homo sapiens
KYPDLER

SEQ ID NO: 29563 - protein, 7 aa, Homo sapiens
KYPDLER

SEQ ID NO: 29564 - protein, 7 aa, Homo sapiens
KYPDLER

SEQ ID NO: 29565 - protein, 7 aa, Homo sapiens
KYPDLER

SEQ ID NO: 29566 - protein, 16 aa, Homo sapiens
EYPAKHAEYSVILQEK

SEQ ID NO: 29567 - protein, 8 aa, Homo sapiens
KYPDLERR

SEQ ID NO: 29568 - protein, 7 aa, Homo sapiens
KYPDLER

SEQ ID NO: 29569 - protein, 7 aa, Homo sapiens
KYPDLER

SEQ ID NO: 29570 - protein, 7 aa, Homo sapiens
KYPDLER

SEQ ID NO: 29571 - protein, 8 aa, Homo sapiens
RKYPDLER

SEQ ID NO: 29572 - protein, 7 aa, Homo sapiens
KYPDLER

SEQ ID NO: 29573 - protein, 7 aa, Homo sapiens
KYPDLER

SEQ ID NO: 29574 - protein, 7 aa, Homo sapiens
KYPDLER

SEQ ID NO: 29575 - protein, 7 aa, Homo sapiens
KYPDLER

SEQ ID NO: 29576 - protein, 7 aa, Homo sapiens
KYPDLER

SEQ ID NO: 29577 - protein, 8 aa, Homo sapiens
KYPDLERR

SEQ ID NO: 29578 - protein, 8 aa, Homo sapiens
RKYPDLER

SEQ ID NO: 29579 - protein, 7 aa, Homo sapiens
KYPDLER

SEQ ID NO: 29580 - protein, 8 aa, Homo sapiens
RKYPDLER

SEQ ID NO: 29581 - protein, 8 aa, Homo sapiens
RKYPDLER

SEQ ID NO: 29582 - protein, 8 aa, Homo sapiens
RKYPDLER

SEQ ID NO: 29583 - protein, 8 aa, Homo sapiens
KYPDLERR

SEQ ID NO: 29584 - protein, 8 aa, Homo sapiens
KYPDLERR

SEQ ID NO: 29585 - protein, 8 aa, Homo sapiens
KYPDLERR

SEQ ID NO: 29586 - protein, 8 aa, Homo sapiens
KYPDLERR

SEQ ID NO: 29587 - protein, 4 aa, Homo sapiens
KVGR

SEQ ID NO: 29588 - protein, 11 aa, Homo sapiens
VEASKVPEYIK

SEQ ID NO: 29589 - protein, 10 aa, Homo sapiens
VPEYIKKAAK

SEQ ID NO: 29590 - protein, 10 aa, Homo sapiens
VPEYIKKAAK

SEQ ID NO: 29591 - protein, 11 aa, Homo sapiens
KAAEFNSNLNR

SEQ ID NO: 29592 - protein, 7 aa, Homo sapiens
DKAATPR

SEQ ID NO: 29593 - protein, 13 aa, Homo sapiens
HAEYSVILQEKER

SEQ ID NO: 29594 - protein, 4 aa, Homo sapiens
KVGR

SEQ ID NO: 29595 - protein, 4 aa, Homo sapiens
KVGR

SEQ ID NO: 29596 - protein, 5 aa, Homo sapiens
KVGRR

SEQ ID NO: 29597 - protein, 8 aa, Homo sapiens
YKVLPTER

SEQ ID NO: 29598 - protein, 18 aa, Homo sapiens
ITDHYKEYSQMQQQNTQK

SEQ ID NO: 29599 - protein, 18 aa, Homo sapiens
ITDHYKEYSQMQQQNTQK

SEQ ID NO: 29600 - protein, 11 aa, Homo sapiens
DLSHKEKLYLR

SEQ ID NO: 29601 - protein, 11 aa, Homo sapiens
DLSHKEKLYLR

SEQ ID NO: 29602 - protein, 6 aa, Homo sapiens
EKLYLR

SEQ ID NO: 29603 - protein, 6 aa, Homo sapiens
EKLYLR

SEQ ID NO: 29604 - protein, 5 aa, Homo sapiens
KDGPK

SEQ ID NO: 29605 - protein, 9 aa, Homo sapiens
SKDKAATPR
